US009920374B2

(12) United States Patent
Brody et al.

(10) Patent No.: US 9,920,374 B2
(45) Date of Patent: Mar. 20, 2018

(54) DIAGNOSTIC FOR LUNG DISORDERS USING CLASS PREDICTION

(71) Applicant: Trustees of Boston University, Boston, MA (US)

(72) Inventors: Jerome S. Brody, Boston, MA (US); Avrum Spira, Newton, MA (US); Jennifer E. Beane-Ebel, Fort Collins, CO (US); Marc E. Lenburg, Berkeley, CA (US)

(73) Assignee: Trustees of Boston University, Boston, MA (US)

( * ) Notice: Subject to any disclaimer, the term of this patent is extended or adjusted under 35 U.S.C. 154(b) by 0 days.

(21) Appl. No.: 14/613,210

(22) Filed: Feb. 3, 2015

(65) Prior Publication Data

US 2015/0354008 A1 Dec. 10, 2015

Related U.S. Application Data

(63) Continuation of application No. 13/524,749, filed on Jun. 15, 2012, now abandoned, which is a continuation of application No. 12/869,525, filed on Aug. 26, 2010, now abandoned, which is a continuation of application No. 11/918,588, filed as application No. PCT/US2006/014132 on Apr. 14, 2006, now abandoned.

(60) Provisional application No. 60/671,243, filed on Apr. 14, 2005.

(51) Int. Cl.
C12Q 1/68 (2006.01)

(52) U.S. Cl.
CPC ..... *C12Q 1/6886* (2013.01); *C12Q 2600/158* (2013.01); *C12Q 2600/16* (2013.01)

(58) Field of Classification Search
None
See application file for complete search history.

(56) References Cited

U.S. PATENT DOCUMENTS

| | | | |
|---|---|---|---|
| 3,640,268 A | 2/1972 | Davis | |
| 4,641,662 A | 2/1987 | Jaicks | |
| 4,800,896 A | 1/1989 | Jalowayski | |
| 5,422,273 A | 6/1995 | Garrison | |
| 5,440,942 A | 8/1995 | Hubbard | |
| 5,477,863 A | 12/1995 | Grant | |
| 5,726,060 A | 3/1998 | Bridges | |
| 5,876,978 A | 3/1999 | Willey et al. | |
| 6,085,907 A | 7/2000 | Hochmeister | |
| 6,746,846 B1 | 6/2004 | Wang et al. | |
| 2002/0160388 A1 | 10/2002 | Macina et al. | |
| 2003/0104499 A1 | 6/2003 | Pressman et al. | |
| 2004/0005294 A1 | 1/2004 | Lee | |
| 2004/0009489 A1 | 1/2004 | Golub et al. | |
| 2004/0063120 A1 | 4/2004 | Beer et al. | |
| 2004/0197785 A1 | 10/2004 | Willey et al. | |
| 2004/0241725 A1 | 12/2004 | Xiao et al. | |
| 2004/0241728 A1 | 12/2004 | Liew | |
| 2005/0260586 A1 | 11/2005 | Demuth et al. | |
| 2005/0266409 A1 | 12/2005 | Brown et al. | |
| 2006/0127928 A1 | 6/2006 | Bacus et al. | |
| 2006/0154278 A1 | 7/2006 | Brody et al. | |
| 2006/0183144 A1 | 8/2006 | Willey et al. | |
| 2006/0188909 A1 | 8/2006 | Willey et al. | |
| 2006/0190192 A1 | 8/2006 | Willey et al. | |
| 2006/0194216 A1 | 8/2006 | Willey et al. | |
| 2007/0092891 A1 | 4/2007 | Willey et al. | |
| 2007/0092892 A1 | 4/2007 | Willey et al. | |
| 2007/0092893 A1 | 4/2007 | Willey et al. | |
| 2007/0148650 A1 | 6/2007 | Brody et al. | |
| 2009/0061454 A1 | 3/2009 | Brody et al. | |
| 2009/0186951 A1 | 7/2009 | Brody et al. | |
| 2009/0311692 A1 | 12/2009 | Brody et al. | |
| 2010/0035244 A1 | 2/2010 | Brody et al. | |
| 2010/0055689 A1 | 3/2010 | Spira et al. | |
| 2011/0190150 A1 | 8/2011 | Brody et al. | |
| 2011/0217717 A1 | 9/2011 | Brody et al. | |
| 2012/0041686 A1 | 2/2012 | Brody et al. | |
| 2012/0190567 A1 | 7/2012 | Brody et al. | |
| 2012/0322673 A1 | 12/2012 | Brody et al. | |

(Continued)

FOREIGN PATENT DOCUMENTS

| | | |
|---|---|---|
| CN | 1688582 A | 10/2005 |
| DE | 10219117 | 10/2003 |
| WO | WO/1999/060160 A1 | 11/1999 |

(Continued)

OTHER PUBLICATIONS

Wojnarowski et al (Eur Respir, 1999, 14: 1136-1144).*
Moller et al (European Journal of Pharmacology, 1999, 365: R1-R3).*
Spira et al (PNAS, 2004, 101(27): 10143-10148).*
Woenckhaus et al (Pathology Research and Practice, 2004, 200(4): 255).*
St. Croix, et al., "Genes Expressed in Human Tumor Endothelium," *Science*, 289:1197-1202, (Aug. 18, 2000).
Final Office Action from U.S. Appl. No. 11/294,834, dated Aug. 22, 2016.
Details for HG-U133A:217291_AT (CEACAM5) (https://www.affymetrix.com/analysis/netaffx/fullrecord.affx?pk=HG-U133A:217291_AT, downloaded Apr. 22, 2016).

(Continued)

*Primary Examiner* — Sean E Aeder
(74) *Attorney, Agent, or Firm* — Lisa M. Warren, Esq.; Morse, Barnes-Brown & Pendleton, P.C.

(57) ABSTRACT

The present invention provides methods for diagnosis and prognosis of lung cancer using expression analysis of one or more groups of genes, and a combination of expression analysis with bronchoscopy. The methods of the invention provide far superior detection accuracy for lung cancer when compared to any other currently available method for lung cancer diagnostic or prognosis. The invention also provides methods of diagnosis and prognosis of other lung diseases, particularly in individuals who are exposed to air pollutants, such as cigarette or cigar smoke, smog, asbestos and the like air contaminants or pollutants.

14 Claims, 35 Drawing Sheets

(56) References Cited

U.S. PATENT DOCUMENTS

| | | |
|---|---|---|
| 2013/0023437 A1 | 1/2013 | Brody et al. |
| 2015/0232945 A1 | 8/2015 | Brody et al. |

FOREIGN PATENT DOCUMENTS

| | | |
|---|---|---|
| WO | WO 2000/006780 | 2/2000 |
| WO | WO 2001/028428 | 4/2001 |
| WO | WO 2002/006791 | 1/2002 |
| WO | WO/2002/086443 A2 | 10/2002 |
| WO | WO 2003/015613 | 2/2003 |
| WO | WO/2003/040325 A2 | 5/2003 |
| WO | WO/2004/005891 A2 | 1/2004 |
| WO | WO 2004/029055 | 4/2004 |
| WO | WO/2004/091511 A2 | 10/2004 |
| WO | WO/2004/111197 A2 | 12/2004 |
| WO | WO/2005/000098 A2 | 1/2005 |
| WO | WO/2005/047451 A2 | 5/2005 |
| WO | WO/2006/113467 A3 | 10/2006 |
| WO | WO/2007/103541 A2 | 9/2007 |
| WO | WO/2009/039457 A2 | 3/2009 |
| WO | WO/2003/029273 A2 | 4/2009 |
| WO | WO/2009/121070 A1 | 10/2009 |
| WO | WO 2002/072866 | 9/2012 |

OTHER PUBLICATIONS

Mollerup, et al., "Sex Differences in Lung CYP1A1 Expression and DNA Adduct Levels among Lung Cancer Patients," Cancer Research, 1999, 59: 3317-3320 (1999).
Saito-Hisaminato, "Genome-Wide Profiling of Gene Expression in 29 Normal Human Tissues with a cNDA Microarray," DNA Research, 2002, 9:35-45.
Willey, et al., "Quantitative RT-PCR Measurement of Cytochromes p450 1A1, 161, and 2B7, Microsomal Epoxide Hydrolase, and NADPH Oxidoreductase Expression in Lung Cells of Smokers and Nonsmokers," Am. J. Respir. Cell Mol. Biol., 1997, 17:114-124.
Non-Final Office Action for U.S. Appl. No. 14/584,960, dated Apr. 27, 2016.
Non-Final Office Action for U.S. Appl. No. 11/294,834, dated Dec. 15, 2015.
Abrahamson, et al., Cystatins. Biochem. Soc. Symp. 70: 179-199 (2003).
Anderson, et al., National Vital Statistics Report; 52(9): 1-88 (Nov. 7, 2003).
Anthonisen, et al., Effects of Smoking Intervention and the Use of an Inhaled Anticholinergic Bronchodilator on the Rate of Decline of FEV1. JAMA; 272(19):1497-1505 (Nov. 16, 1994).
Beane, et al., A Prediction Model for Lung Cancer Diagnosis that Integrates Genomic and Clinical Features, Cancer Prev Res 2008, 1:56-64 (2008).
Beane, et al., Reversible and permanent effects of tobacco smoke exposure on airway epithelial gene expression. Genome Biology 2007, 8:R201 (Sep. 25, 2007).
Beer, et al., Gene-expression profiles predict survival of patients with lung adenocarcinoma. Nature Medicine, 8: 816-824 (2002).
Belinksky, et al., Aberrant promoter methylation in bronchial epithelium and sputum from current and former smokers. Cancer Res., 62(8): 2370-7 (2002).
Berman, Jeffrey S, Abstract Immunopathology of the nasal mucosa in sarcoidosis National Institutes of Health Grant No. 1 R21 HL077498-01 (Funding Start Date Sep. 15, 2004).
Beum, et al., Epidermal Growth Factor Downregulates Core 2 Enzymes in a Human Airway Adenocarcinoma Cell Line. Am. J. Respir. Cell Mol. Biol., 29:48-56 (2003).
Bhattacharjee, et al., Classification of human lung carcinoma by mRNA expression profiling reveals distinct adenocarcinoma subclasses. Proc Natl Acad Sci USA, 98(24): 13790-5 (Nov. 20, 2001).
Bild, et al., Oncogenic pathway signatures in human cancers as a guide to targeted therapies. Nature, 439: 353-357 (2006).

Chari, et al., Effect of active smoking on the human bronchial epithelium transcriptome. BMC Genomics, 8:297 (Aug. 29, 2007).
Clark, A., et al., "Altered Protein Kinase C (PKC) Isoforms in Non-Small Cell Lung Cancer Cells: PKCdelta Promotes Cellular Survival and Chemotherapeutic Resistance," Cancer Research, 63(4): 780-786 (2003).
Crawford, et al., Normal Bronchial Epithelial Cell Expression of Glutathione Transferase P1, Glutathione Transferase M3, and Glutathione Peroxidase is Low in Subjects with Bronchogenic Carcinoma, Cancer Research, 60: 1609-1618 (Mar. 15, 2000).
Cummings, Sr. et al., Estimating the probability of malignancy in solitary pulmonary nodules. A Bayesian approach, Am Rev Respir Dis 1986;134:449-52 (1986).
Demeo, et al., The SERPINE2 gene is associated with chronic obstructive pulmonary disease. Am J Hum Genet., 78(2): 253-264 (Feb. 2006).
Denis, et al., RING3 Kinase Transactivates Promoters of Cell Cycle Regulatory Genes through E2F1 Cell. Growth Differ; 11: 417-424 (Aug. 2000).
R. et al., Mortality in relation to smoking: 40 years' observations on male British doctors. BMJ; 309:901-911 (Oct. 8, 1994).
Ebbert, et al., Lung Cancer Risk Reduction After Smoking Cessation: Observations From a Prospective Cohort of Women. J Clin Oncol; 21(5):921-926 (Mar. 1, 2003).
Fahy, JV. Remodeling of the Airway Epithelium in Asthma. Am. J. Respir. Crit. Care Med. 164:S46-S51 (2001).
Freeman, et al., DNA from Buccal Swabs Recruited by Mail: Evaluation of Storage Effects on Long-term Stability and Suitability for Multiplex Polymerase Chain Reaction Genotyping, Behavior Genetics, 33: 67 (2003).
Garber, et al., Diversity of gene expression in adenocarcinoma of the lung. PNAS, 98(24): 13784-13789 (Nov. 20, 2001).
Garcia-Closas, Collection of Genomic DNA from Adults in Epidemiological Studies by Buccal Cytobrush and Mouthwash, Cancer Epidemiology, Biomarkers and Prevention, 10: 687-696, (2001).
Gebel, et al., Gene expression profiling in respiratory tissues from rats exposed to mainstream cigarette smoke. Carcinogenesis, 25(2): 169-178 (2004).
Golub, et al., Molecular classification of cancer: Class discovery and class prediction by gene expression monitoring, Science, American Association for the Advancement of Science, 286:5439 (Oct. 15 1999).
Greenlee, et al., Cancer Statistics, 2001. CA Cancer J Clin; 51(1):15-36 (2001).
Gurney, JW. Determining the likelihood of malignancy in solitary pulmonary nodules with Bayesian analysis, Part 1, Theory. Radiology 1993;186:405-13 (2005).
Hackett, et al., Variability of antioxidant-related gene expression in the airway epithelium of cigarette smokers. Am J Respir Cell Mol Biol., 29: 331-43 (2003).
Hecht, SS., Tobacco carcinogens, their biomarkers and tobacco-induced cancer. Nature Review Cancer; 3:733-744 (Oct. 2003).
Jang, et al., Activation of melanoma antigen tumor antigens occurs early in lung carcinogenesis. Cancer Research 61: 7959-7963 (2001).
Kanner, et al., Effects of randomized assignment to a smoking cessation intervention and changes in smoking habits on respiratory symptoms in smokers with early chronic obstructive pulmonary disease: the lung health study. American Journal of Medicine; 106:410-416 (1999).
Kao, et al., Tumor-associated Antigen L6 and the Invasion of Human Lung Cancer Cells. Clin Cancer Res. 9:2807-2816 (Jul. 2003).
Katz, et al., Automated detection of genetic abnormalities combined with cytology in sputum is a sensitive predictor of lung cancer, Modern Pathology;21:950-960 (2008).
Kazemi-Noureini, et al., Differential gene expression between squamous cell carcinoma of esophageus and its normal epithelium; altered pattern of mal, akrlc2, and rab11a expression. World J Gastroenterol, 10(12): 1716-1721 (2004).
Kitahara, et al. Alternations of Gene Expression during Colorectal Carcinogenesis Revealed by cDNA Microarrays after Laser-Capture

(56) References Cited

OTHER PUBLICATIONS

Microdissection of Tumor Tissues and Normal Epithelia. Cancer Research, 61: 3544-3549 (May 1, 2001).
Lander, et al., Initial sequencing and analysis of the human genome. Nature, 409: 860-921 (Feb. 15, 2001).
Li, L., Survival prediction of diffuse large-B-cell lymphoma based on both clinical and gene expression information, Bioinformatics 2006; 22:466-71 (2006).
Liao, et al., Expression and significance of PTEN/PI3K signal transduction-related proteins in nonsmall cell lung cancer, Ai Zheng 25: 10, p. 1238-42. Abstract (2006).
Liu et al., Effects of physiological versus pharmacological β-carotene supplementation on cell proliferation and histopathological changes in the lungs of cigarette smoke-exposed ferrets. Carcinogenesis, 21: 2245-2253 (2000).
Mannino, DM. et al., Low lung function and incident lung cancer in the United States: data From the First National Health and Nutrition Examination Survey follow-up, Arch Intern Med. 163(12):1475-80 (2003).
Medical News: Targeted, Oral Agent Enzastaurin Shows Favorable Results in Late-Stage Lung Cancer. (Jun. 11, 2007), Retrieved from the Internet <URL: http://www.medicalnewstoday.com/articles/73761.php>.
Michalczyk, et al., Fresh and cultured buccal cells as a source of mRNA and protein for molecular analysis. Biotechniques. 37(2):262-4, 266-9 (2004).
Miklos, et al., Microarray reality checks in the context of a complex disease. Nature Biotechnology, 22:5 (May 2005).
Miura, et al., Laser capture microdissection and microarray expression analysis of lung adenocarcinoma reveals tobacco smoking- and prognosis-related molecular profiles. Cancer Res., 62(11): 3244-50 (Jun. 1, 2002).
Mongiat, et al., Fibroblast Growth Factor-binding Protein is a Novel Partner for Perlecan Protein Core. The Journal of Biological Chemistry; 276(13):10263-10271 (Mar. 30, 2001).
Neubauer, et al., Cure of Helicobacter pylori Infection and Duration of Remission of Low-Grade Gastric Mucosa-Associated Lymphoid Tissue Lymphoma. J. Natl. Cancer Inst., 89(18): 1350-1378 (Sep. 17, 1997).
Okudela, K., et al., "K-ras Gene Mutation Enhances Motility of Immortalized Airway Cells and Lung Adenocarcinoma Cells via Akt Activation: Possible Contribution to Non-Invasive Expansion of Lung Adenocarcinoma," The American Journal of Pathology, 164(1): 91-100 (2004).
Pittman, J. et al., Integrated modeling of clinical and gene expression information fo personalized prediction of disease outcomes, Proc Natl Acad Sci U S A 2004; 101:8431-1 (2004).
Potti et al., A Genomic Strategy to Refine Prognosis in Early-Stage Non Small-Cell Lung Cancer, The New England Journal of Medicine 2006; 335(6):570-580 (2006).
Powell, et al., Patterns of allelic loss differ in lung adenocarcinomas of smokers and nonsmokers. Lung Cancer, 39(1): 23-29 (2003).
Powell, et al., Gene expression in lung adenocarcinomas of smokers and nonsmokers. American Journal of Respiratory Cell and Molecular Biology, 29: 157-162 (Aug. 2003).
Proctor RN., Tobacco and the global lung cancer epidemic. Nature Reviews Cancer, 1: 82-86 (Oct. 2001).
Rusznak, et al., Effect of Cigarette Smoke on the Permeability and IL-1B and sICAM-1 Release from Cultured Human Bronchial Epithelial Cells of Never-Smokers, Smokers, and Patients with Chronic Obstructive Pulmonary Disease. Am. J. Respir. Cell Mol. Biol., 23:530-536 (2000).
Saheki, et al., Pathogenesis and pathophysiology of citrin (a mitochondrial aspartate glutamate carrier) deficiency. Metabolic Brain Disease; 17(4):335-346 (Dec. 2002).
Schembri, Frank et al., MicroRNAs as modulators of smoking-induced gene expression changes in human airway epithelium, Proc Natl Acad Sci U S A, 106(7):2319-24 (Feb. 2009).
Shields, PG., Molecular epidemiology of lung cancer. Annals of Oncology, 10(5):S7-S11 (1999).

Shriver, et al., Sex-Specific Expression of Gastrin-Releasing Peptide Receptor: Relationship to Smoking History and Risk of Lung Cancer. J. Natl. Cancer Inst., 92: 24-33 (2000).
Spira, et al., Noninvasive method for obtaining RNA from buccal mucosa epithelial cells for gene expression profiling. Biotechniques, 36(3): 484-7 (2004).
Spira, et al., Effects of cigarette smoke on the human airway epithelial cell transcriptome, PNAS, 101: 27, p. 10143-10148 (Jul. 6, 2004).
Spira, et al., Airway epithelial gene expression in the diagnostic evaluation of smokers with suspect lung cancer. Nature Medicine 13: 361-366 (2007).
Spira, et al., Gene Expression Profiling of Human Lung Tissue from Smokers with Severe Emphysema. Am J Respir Cell Mol Biol., 31 6 :601-10 (2004).
Spira, et al., Impact of cigarette smoke on the normal airway transcriptome. Chest. 125 (5 Suppl):115S (May 2004).
Spira, Avrum E., Abstract The airway transcriptome as a biomarker for lung cancer National Institutes of Health Grant No. 1 R21 CA106506-01 (Funding Start Date Aug. 9, 2005).
Spira, Avrum E., Abstract Airway gene expression in smokers: an early diagnostic biomarker for lung cancer National Institutes of Health Grant No. 1 R01 CA124640-01 (Funding Start Date May 1, 2007).
Spivack, et al., Gene-environment interaction signatures by quantitative mRNA profiling in exfoliated buccal mucosal cells, Cancer Research, 64: 18, p. 6805-6813 (2004).
Sridhar, et al. Smoking-induced gene expression changes in the bronchial airway are reflected in nasal and buccal epithelium. BMC Genomics, 9: 259 (May 2008).
Stephenson, AJ. et al.,Integration of gene expression profiling and clinical variables to predict prostate carcinoma recurrence after radical prostatectomy, Cancer 2005; 104:290-8 (2005).
Stewart, JH. Lung Carcinoma in African Americans, A Review of the Current Literature. Cancer; 91(12): 2476-2482 (Jun. 15, 2001).
Swensen, SJ. et al., The probability of malignancy in solitary pulmonary nodules. Application to small radiologically indeterminate nodules, Arch Intern Med 1997; 157:849-55 (1997).
Swensen, SJ. et al., Abstract Solitary pulmonary nodules: clinical prediction model versus physicians, Mayo Clinic Proc 1999; 74:319-29 (1999).
Theocharis, et al., Metallothionein: a multifunctional protein from toxicity to cancer. Int Biol Markers, 18(3):162-169 (2003).
Thurston, SW. et al., Modeling lung cancer risk in case-control studies using a new dose metric of smoking, Cancer Epidemiol Biomarkers Prev 2005; 14(10): 2296-302 (2005).
Trunk, G. et al., The management and evaluation of the solitary pulmonary nodule, Chest 1974; 66:236-9 (1974).
Ung, YC. et al., Fluorodeoxyglucose positron emission tomography in the diagnosis and staging of lung cancer: a systematic review, J Nat'l Cancer Institute, 99(23): 1753-67 (2007).
Volm, et al., Prognostic significance of the expression of c-fos, c-jun and c-erbB-1 oncogene products in human squamous cell lung carcinomas. J Cancer Res Clin Oncol, 119: 507-510 (1993).
Wahdi, MM. et al., Evidence for the treatment of patients with pulmonary nodules: when is it lung cancer? ACCP evidence-based clinical practice guidelines $2^{nd}$ Edition, Chest 2007; 132:94-107S (2007).
West, M., et al. Embracing the complexity of genomic data for personalized medicine, Genome Res 2006; 16:559-66 (2006).
Wistuba, et al., Molecular damage in the bronchial epithelium of current and former smokers. J Natl Cancer Inst., 89(18): 1366-73 (Sep. 17, 1997).
Wistuba, et al., High resolution chromosome 3p allelotyping of human lung cancer and preneoplastic/preinvasive bronchial epithelium reveals multiple, discontinuous sites of 3p allele loss and three regions of frequent breakpoints. Cancer Res., 60(7): 1949-60 (Apr. 1, 2000).
Zeeberg, et al.. GoMiner: a resource for biological interpretation of genomic and proteomic data. Genome Biology, 4(4):R28.1-R28.8 (2003).

(56) References Cited

OTHER PUBLICATIONS

Zhang, et al. Comparison of smoking-induced gene expression on Affymetrix Exon and 3'-based expression arrays. Genome Inform. 18: 247-57 (2007).
Retracted in Jan. 2011—Potti, A., et al., "Genomic Signatures to Guide the Use of Chemotherapeutics," Nature Medicine, 12(11): 1294-1300 (2006).
Ambion, Inc. "GeneAssist Pathway Atlas for P13K Signaling," Accessed from http://www5.appliedbiosystems.com/tools/pathway/pathway_proteins.php?pathway=P13K on May 3, 2011.
Arimura, et al. Elevated Serum β-Defensins Concentrations in Patients with Lung Cancer, *Anticancer Research*, 24: 4051-4058 (2004).
Baker, Stuart. "The Central Role of Receiver Operating Characteristic (ROC) Curves in Evaluating Tests for the Early Detection of Cancer," *Journal of the National Cancer Institute*, 95(7): 511-515 (2003).
Braakhuis, et al. "A Genetic Explanation of Slaughter's Concept of Field Cancerization Evidence and Clinical Implications," *Cancer Research*, 63: 1727-1730 (2003).
Chan, et al. Intefrating Trasnscriptomics and Protemoics, *Genomics & Proteomics Magazine*, 6(3), text of article reprinted and accessed from www.dddmag.com on May 27, 2005.
Chen, et al. "Discordant Protein and mRNA Expression in Lung Adenocarcinomas," *Molecular and Cellular Proteomics*, 1: 304-313 (2001).
Dauletbaev, et al. "Expression of Human Beta Defensin (HBD-1 and HBD-2) mRNA in Nasal Epithelia of Adult Cystic Fibrosis Patients, Healthy Individuals, and Individuals with Acute Cold," *Respiration*, 69:46-51 (2002).
Franklin, et al. "Widely Dispersed p53 Mutation in Respiratory Epithelium," *The Journal of Clinical Investigation*, 100(8): 2133-2137 (1997).
Hellmann, et al. "Gene Profiling of Cultured Human Bronchia Epithelial and Lung Cacinoma Cells," *Toxicological Sciences*, 61: 154-163 (2001).
Ikeda, et al. "Malignancy associated changes in bronchial epithelial cells and clinical application as a biomarker," *Lung Cancer*, 19(3): 161-166 (1998).
Kraft, et al. "Expression of epithelial markers in nocturnal asthma," *Journal of Allergy and Clinical Immunology*, 102 (3): 376-381 (1998).
Liu, et al. "Quantitative Proteome Analysis Reveals Annexin A3 as a Novel Biomarker in Lung Adenocarcinoma," *Journal of Pathology*, 217: 54-64 (2009).
Reynolds, et al. "Pre-protachykinin-A mRNA is increased in the airway epithelium of smokers with chronic bronchitis." *Respiratory*, 6:187-197 (2001).
Riise, et al. "Bronchial Brush Biopsies for Studies of Epithelial Inflammation in Stable Asthma and Nonobstructive Chronic Bronchitis," *European Respiratory Journal*, 9: 1665-1671 (1996).
Slonim, Donna. "From Patterns to Pathways: Gene Expression Data Analysis Comes of Age," *Nature Genetics Supplement*, 32: 502-508 (2002).
Takizawa, et al. "Increased expression of transforming growth factor-beta1 in small airway epithelium from tobacco smokers and patients with chronic obstructive pulmonary disease (COPD)," *American Journal of Respiratory and Critical Care Medicine*, 163:1476-1483 (2001).
Watters, et al. "Developing Gene Expression Signatures of Pathway Deregulation in Tumors," *Molecular Cancer Therapeutics*, 5: 2444-2449 (2006).
Ohtsuka, et al., Ohtsuka, et al., "ADAM28 is overexpressed in human non-small cell lung carcinomas and correlates with cell proliferation and lymph node metastasis," *International Journal of Cancer*, 118(2): 263-273 (2006).
Hamilton and Sharp, "Diagnosis of lung cancer in primary care: a structured review," *Family Practice*, 21(6), 605-611 (2004).
Akita, et al., "Molecular Biology of Lung Cancer," *The Journal of the Japanese Respiratory* Society, 42(5): (2004).

Printout from database NCBI GEO accession No. GSE4115 [Online] NCB, dated Feb. 27, 2006.
Brody, Jerome S., Abstract "Airway epithelial gene expression in COPD" National Institutes of Health Grant No. 1 R01 HL071771-01 (Funding Start Date Sep. 30, 2002).
Kiss, et al., "Anatomisk Atlas over Manniskokroppen, band II," Natur och Kultur Stockholm, Stockholm, Sweden ISBN: 91-27-67278-6 (1973).
Bohula et al., "The Efficacy of Small Interfering RNAs Targeted to the Type 1 Insulin-like Growth Factor Receptor (IGF1R) is Influenced by Secondary Structure in the IGF1R Transcript," The Journal of Biological Chemistry 278(18): 15991-15997 (2003).
Wardlaw, et al., "Effect of cigarette smoke on CYPIA1, CYP1A2 and CYP2B1/2 of nasal mucosae in F344 rats," Carcinogenesis 19(4): 655-662 (1998).
Lin, et al., "Effects of Dexamethasone on Acute Lung Injury Rat Cells Signal Transduction Systems ERK and PI3-K," Medical Journal of Chinese People's Liberation Army 6(31): 592-594 (2006).
Guajardo, et al., "Altered gene expression profiles in nasal respiratory epithelium reflect stable versus actue childhood asthma", J. Allergy Clin Immunol 115(2): 243-251 (2005).
Voynow, et al., "Mucin Gene Expression (MUC1, MUC2, and MUC5/5AC) in Nasal Epithelial Cells of Cystic Fibrosis, Allergic Rhinitis, and Normal Individuals", Lung 176: 345-354 (1998).
Shah et al., "SIEGE: Smoking Induced Pithelial Gene Expression Database", Nucleic Acids Research, 33: D573-D579 (2005).
Enard et al., "Intra- and Interspecific Variation in Primate Gene Expression Patterns", Science 296: 340-343 (2002).
Cheung, et al., "Natural variation in human gene expression assessed in lymphoblastiod cells", Nature Genetics, 33: 422-425 (2003).
Wu, Thomas D., "Analysing gene expression data from DNA microarrays to identify candidate genes", Journal of Pathology, 195:53-65 (2001).
Newton, et al., "On Differential Variability of Expression Ratios: Improving Statistical Inference about Gene Expression Changes from Microarray Data", Journal of Computational Biology, 8: 37-52 (2001).
Fritz, et al., "Nasal mucosal gene expression in patients with allergic rhinitis with and without nasal polyps", Journal of Allergy Clin. Immunol, 112(6): 1057-1063 (2003).
Lam, et al., "A Phase I Study of myo-Inositol for Lung Cancer Chemoprevention", Cancer Epidemiology, Biomarkers & Prevention 15(8): 1526-1531 (2006).
Peluso, et al., "Comparison of DNA adduct levels in nasal mucosa, lymphocytes and bronchial mucosa of cigarette smokers and interaction with metabolic gene polymorphisms", Carcinogenesis 25(12): 2459-2465 (2004).
Marinov, et al., "Targeting mTOR signaling in lung cancer", Critical Reviews in Oncology/Hematology 63: 172-182 (2007).
Singhal, et al., "Alterations in Cell Cycle Genes in Early Stage Lung Adenocarcinoma Identified by Expression Profiling", Cancer Biology & Therapy 2(3): 291-299 (2003).
Hennessy, et al., "Exploiting the PI3K/AKT Pathway for Cancer Drug Discovery," Nature, vol. 4: 988-1004 (2005).
Langford, et al., "Is the Property of Being Positively Correlated Transitive," The American Statistician 55(4): 322-325 (2001).
Saal, et al., "Poor Prognosis in Carcinoma is Associated with a Gene Expression Signature of Aberrant PTEN Tumor Suppressor Pathway Activitiy," PNAS 104(18): 7564-7569 (2007).
Sotos, et al., "The Transitivity Misconception of Pearson's Correlation Coefficient," Statistics Education Research Journal 8(2): 33-55 (2009).
Ronald A. Thisted, "What is a P-value", Departments of Statistics and Health Studies, The University of Chicago, May 25, 1988.
Tichelaar, et al., "Increased Staining for Phospho-Akt, p65/RELA and cIAP-2 in Pre-neoplastic Human Bronchial Biopsies," BMC Cancer 5(155): 1-13 (2005).
Tsao, et al, "Increased Phospho-AKT (Ser$^{473}$) Expression in Bronchial Dysplasia: Implications for Lunch Cancer Prevention Studies," Cancer, Epidemiology, Biomarkers & Prevention 12:660-664 (2003).

(56) References Cited

OTHER PUBLICATIONS

West, et al, "Rapid Akt Activation by Nicotine and Tobacco Carcinogen Modulates the Phenotype of Normal Human Airway Epithelial Cells," The Journal of Clinical Investigation 111(1): 81-90 (2003).
Singhal, et al., "Alterations in Cell Cycle Genes in Early Stage Lung Adenocarcinoma Identified by Expression Profiling," Cancer Biology & Therapy 2(3): 291-299 (2003).
Hoshikawa, et al., "Hypoxia induces difference genes in the lungs of rats compared with mice," Physiol Genomics 12: 209-219 (2003).
Cheng, et al., "Reduced expression levels of nucleotide excision repair genes in lung cancer: a case-control analysis," Carcinogenesis 21(8): 1527-1530 (2000).
Fielding, et al., "Heterogeneous Nuclear Ribonucleoprotein A2/B1 Up-Regulation in Bronchial Lavage Specimens: A Clinical Marker of Early Lung Cancer Detection," Clinical Cancer Research 5:4048-4052 (1999).
Danel, et al., "Quantitative assessment of the epithelial and inflammatory cell populations in large airways of normal and individuals with cystic fibrosis," American Journal of Respiratory and Critical Care Medicine 153(1): 362-368 (1996).
Merriam-Webster.com (htpp://www.merriam-webster.com/dictionary/questionnaire, downloaded Oct. 26, 2013).
Tarca, et al., "Analysis of microarray experiments of gene expression profiling," American Journal of Obstetrics and Gynecology 195(2): 373-388 (2006).
May, "How many species are there on earth?" Science 241(4872): 1441-1449 (1988).
Benner, et al. "Evolution, language and analogy in functional genomics," Trends in Genetics 17(7): 414-418 (2001).
Modrek, et al., "Genome-wide detection of alternative splicing in expressed sequences of human genes," Nucleic Acids Research 29(13): 2850-2859 (2001).
Woenckhaus, et al., "Smoking and cancer-related gene expression in bronchial epthelium and non-small-cell lung cancers," The Journal of Pathology 210(2): 192-204 (2006).
Yu-Rong, et al., "Tumor associated antigen L6 and the invasion of human lung cancer cells." Clinical Cancer Research 9(7): 2807-16 (2003).
Dempsey, et al., "Lung disease and PKCs," Pharmacological Research 55(6): 545-59 (2007).
MacKay et al., "Targeting the protein kinase C family: are we there yet?" Nature Reviews Cancer 7(7): 554-62 (2007).
Gustafson, et al., "Airway PI3K Pathway Activation is an Early and Reversible Even in Lung Cancer Development," www.ScienceTransmlationMedicine.org 2(26) (2010).
Fukumoto, et al., "Overexpression of the Aldo-Keto Reductase Family Protein AKR1B10 is Highly Correlated with Smokers' Non-Small Cell Lung Carcinomas," Clinical Cancer Research 11:1776-1786 (2005).
Whitehead et al., "Variation in tissue-specific gene expression among natural populations," Genome Biology 6(2):R13.1-R13.14 (2005).
Details for HG-U133A:202831_AT (https://www.affymetrix.com/analysis/netaffx/fullrecord.affx?pk=HG-U133A:202831_AT, downloaded Dec. 10, 2012).
Details for HG-UI33A:210519_S_AT (https://www.affymetrix.com/analysis/netaffx/fullrecord.affx?pk=HG-U133A:210519_S_AT downloaded Dec. 10, 2012.
HG-U133a-207469_S_AT (https:www//affymetrix.com/analysis/netaffx/fullrecord.affx?pk= HG-U133A:207469_S_AT, downloaded Dec. 10, 2012.
HG-U133A:823_AT (https://www.affymetrix.com/analysis/netaffx/fullrecord.affx?pk=HG-U133A:823_AT, downloaded Dec. 10, 2012.
Demoly, et al., "c-fos Proto-oncogene Expression in Bronchial Biopsies of Asthmatics," American Journal of Respiratory Cell and Molecular Biology 7:128-133 (1992).
European Search Report in Application EP 10 19 5822, dated Jun. 20, 2011.
European Search Report in Application EP 10 19 5803, dated Jun. 20, 2011.
European Search Report in Application EP 10 18 4732, dated Mar. 21, 2011.
European Search Report in Application EP 10 18 4813, dated Mar. 21, 2011.
European Search Report in Application EP 10 18 4888, dated Mar. 21, 2011.
European Search Report in Application EP 04 81 0818, dated Oct. 28, 2010.
European Search Report in Application EP 08 83 2403, dated Oct. 22, 2010.
European Search Report in Application EP 09 72 4548, dated Jun. 16, 2011.
European Search Report for European Application No. EP 10195816, dated Oct. 13, 2011.
European Search Report in Application EP 12 17 0635, dated Apr. 22, 2013.
Chinese Search Report in Application 2008801147951 dated Aug. 24, 2012.
Non-Final Office Action for U.S. Appl. No. 12/234,588, dated Jun. 27, 2011.
Non-Final Office Action for U.S. Appl. No. 10/579,376, dated Jul. 9, 2008.
Non-Final Office Action for U.S. Appl. No. 11/294,834, dated Jun. 24, 2008.
Non-Final Office Action for U.S. Appl. No. 12/884,714, dated Sep. 23, 2011.
Final Office Action for U.S. Appl. No. 12/234,588, dated Nov. 4, 2011.
Non-Final Office Action for U.S. Appl. No. 12/414,555, dated Nov. 30, 2011.
Final Office Action for U.S. Appl. No. 12/414,555, dated Mar. 15, 2012.
Non-Final Office Action for U.S. Appl. No. 13/323,655 dated Apr. 9, 2013.
Non-Final Office Action for U.S. Appl. No. 13/524,749, dated Sep. 9, 2013.
Non-Final Office Action for U.S. Appl. No. 12/234,588, dated Mar. 28, 2014.
Final Office Action for U.S. Appl. No. 13/524,749, dated Apr. 3, 2014.
Final Office Action for U.S. Appl. No. 13/323,655, dated Jul. 17, 2014.
Final Office Action for U.S. Appl. No. 11/294,834, dated Aug. 18, 2014.
Final Office Action for U.S. Appl. No. 13/346,444, dated Nov. 27, 2013.
Non-Final Office Action for U.S. Appl. No. 11/294,834, dated Jan. 29, 2014.
Non-Final Office Action for U.S. Appl. No. 13/346,444, dated Dec. 12, 2012.
Non-Final Office Action for U.S. Appl. No. 13/323,655, dated Nov. 7, 2013.
Lacroix, et al., "Sensitive Detection of Rare Cancer Cell in Sputum and Peripheral Blood Samples of Patients with Lunch Cancer by Preprogrp-Specific TR-PCR," Int. J. Cancer, vol. 92: 1-8 (2001).
Brambilla, et al., "p53 Mutant Immunophenotype and Deregulation of p53 Transcription Pathway (Bc12, Bax and Waf1) in Precursor Bronchial Lesions of Lunch Cancer," Clinical Cancer Research (4): 1609-1618 (1998).
Hirsch, et al., "Early Detection of Lung Cancer: Clinical Perspectives of Recent Advances in Biology and Radiology," Clinical Cancer Research (7): 5-22 (2001).
DeMuth, et al., "The Gene Expression of Index c-myc X E2F-1/p21 is Highly Predictive of Malignant Phenotype in Human Bronchial Epithelial Cells," Am. J. Cell Mol. Bio. (19): 18-24 (1998).
Anbazhagan, et al., "Classification of Small Cell Lung Cancer and Pulmonary Carcinoid by Gene Expression Profiles," Cancer Research, 59:5119-5122, (Oct. 15, 1999).

(56) References Cited

OTHER PUBLICATIONS

Chen, et al., "Up-regulations of Tumor Interleukin-8 Expression by Infiltrating Macrophages: Its Correlation with Tumor Angiogenesis and Patient Survival in Non-Small Cell Lung Cancer," *Clinical Cancer Research*: p. 729, (Feb. 1, 2003).

Khan, et al., "Classification and Diagnostic Prediction of Cancers Using Gene Expression Profiling and Artificial Neural Networks," *Nature Medicine*, 7(6):673-679, (Jun. 2001).

Extended European Search Report from EP 16186152.1, dated May 31, 2017.

Non-Final Office Action for U.S. Appl. No. 11/294,834, dated Jul. 29, 2014.

Final Office Action for U.S. Appl. No. 14/500,475, dated Feb. 28, 2017.

Non-Final Office Action for U.S. Appl. No. 15/439,791, dated Jun. 14, 2017.

Final Office Action for U.S. Appl. No. 14/500,475, dated Aug. 2, 2017.

\* cited by examiner

| Table 1: 96 gene Group | | | |
|---|---|---|---|
| GenBank ID | Gene Name | Direction of expression in lung Cancer | Exemplary probe: Affymetrix Id in the Human Genome U133 chip |
| NM_003335 | UBE1L | down | 1316_at |
| NM_000918 | P4HB | up | 200654_at |
| NM_006430.1 | CCT4 | up | 200877_at |
| NM_001416.1 | EIF4A1 | up | 201530_x_at |
| NM_004090 | DUSP3 | up | 201537_s_at |
| NM_006406.1 | PRDX4 | up | 201923_at |
| NM_003001.2 | SDHC | up | 202004_x_at |
| NM_001319 | CSNK1G2 | down | 202573_at |
| NM_006545.1 | TUSC4 | up | 203246_s_at |
| NM_021145.1 | DMTF1 | down | 203301_s_at |
| NM_002437.1 | MPV17 | up | 203466_at |
| NM_006286 | TFDP2 | up | 203588_s_at |
| NM_001003698 /// NM_001003699 /// NM_002955 | RREB1 | down | 203704_s_at |
| NM_001123 /// NM_006721 | ADK | up | 204119_s_at |
| NM_024824 | FLJ11806 | up | 204216_s_at |
| NM_004935.1 | CDK5 | up | 204247_s_at |
| NM_002853.1 | RAD1 | down | 204461_x_at |
| NM_019067.1 | FLJ10613 | down | 205010_at |
| NM_024917.1 | CXorf34 | down | 205238_at |
| NM_020979.1 | APS | down | 205367_at |
| NM_005597.1 | NFIC | down | 206929_s_at |
| NM_007031.1 | HSF2BP | down | 207020_at |
| NM_009590.1 | AOC2 | down | 207064_s_at |

*FIG. 1*

| | | | |
|---|---|---|---|
| NM_020217.1 | DKFZp547I014 | down | 207283_at |
| NM_025026.1 | FLJ14107 | down | 207287_at |
| NM_014709.1 | USP34 | down | 207365_x_at |
| NM_014896.1 | KIAA0894 | down | 207436_x_at |
| AF010144 | --- | down | 207953_at |
| NM_005374.1 | MPP2 | down | 207984_s_at |
| NM_001696 | ATP6V1E1 | up | 208678_at |
| NM_005494 /// NM_058246 | DNAJB6 | up | 209015_s_at |
| NM_006534 /// NM_181659 | NCOA3 | down | 209061_at |
| NM_006368 | CREB3 | up | 209432_s_at |
| NM_002268 /// NM_032771 | KPNA4 | up | 209653_at |
| NM_014033 | DKFZP586A0522 | down | 209703_x_at |
| NM_016138 | COQ7 | down | 209746_s_at |
| NM_007048 /// NM_194441 | BTN3A1 | down | 209770_at |
| NM_006694 | JTB | up | 210434_x_at |
| NM_000051 /// NM_138292 /// NM_138293 | ATM | down | 210858_x_at |
| NM_000410 /// NM_139002 /// NM_139003 /// NM_139004 /// NM_139005 /// NM_139006 /// NM_139007 /// NM_139008 /// NM_139009 /// NM_139010 /// NM_139011 | HFE | down | 211328_x_at |

FIG. 1 (continued)

| | | | |
|---|---|---|---|
| NM_004691 | ATP6V0D1 | up | 212041_at |
| NM_012070 /// NM_139321 /// NM_139322 | ATRN | down | 212517_at |
| NM_006095 | ATP8A1 | down | 213106_at |
| AI632181 | --- | down | 213212_x_at |
| AW024467 | --- | down | 213919_at |
| NM_021814 | ELOVL5 | down | 214153_at |
| NM_005547.1 | IVL | down | 214599_at |
| NM_203458 | N2N | down | 214722_at |
| NM_015547 /// NM_147161 | THEA | down | 214763_at |
| AB007958.1 | KIAA0792 | down | 214833_at |
| NM_207488 | FLJ42393 | down | 214902_x_at |
| NM_005809 /// NM_181737 /// NM_181738 | PRDX2 | down | 215067_x_at |
| NM_016248 /// NM_144490 | AKAP11 | down | 215336_at |
| AK022213.1 | FLJ12151 | down | 215373_x_at |
| NM_005708 | GPC6 | down | 215387_x_at |
| NM_207102 | FBXW12 | down | 215600_x_at |
| AK023895 | --- | down | 215609_at |
| NM_144606 /// NM_144997 | FLCN | down | 215645_at |
| NM_018530 | GSDML | down | 215659_at |
| AK021474 | --- | down | 215892_at |
| U43604.1 | --- | down | 216012_at |
| AU147017 | --- | down | 216110_x_at |
| AF222691.1 | LNX1 | down | 216187_x_at |
| NM_015116 | LRCH1 | down | 216745_x_at |

*FIG. 1 (continued)*

| | | | |
|---|---|---|---|
| NM_001005375 /// NM_001005785 /// NM_001005786 /// NM_004081 /// NM_020363 /// NM_020364 /// NM_020420 | DAZ2 | down | 216922_x_at |
| AC004692 | --- | down | 217313_at |
| NM_001014 | RPS10 | down | 217336_at |
| NM_000585 /// NM_172174 /// NM_172175 | IL15 | down | 217371_s_at |
| NM_054020 /// NM_172095 /// NM_172096 /// NM_172097 | CATSPER2 | down | 217588_at |
| BE466926 | --- | down | 217671_at |
| NM_018011 | FLJ10154 | down | 218067_s_at |
| NM_024077 | SECISBP2 | down | 218265_at |
| NM_012394 | PFDN2 | up | 218336_at |
| NM_019011 /// NM_207111 /// NM_207116 | TRIAD3 | down | 218425_at |
| NM_017646 | TRIT1 | down | 218617_at |
| NM_021800 | DNAJC12 | up | 218976_at |
| NM_016049 | C14orf122 | up | 219203_at |
| NM_014395 | DAPP1 | down | 219290_x_at |
| NM_014336 | AIPL1 | down | 219977_at |
| NM_018097 | C15orf25 | down | 220071_x_at |
| NM_019014 | POLR1B | down | 220113_x_at |
| NM_024804 | FLJ12606 | down | 220215_at |
| NM_018260 | FLJ10891 | down | 220242_x_at |
| NM_018118 | MCM3APAS | down | 220459_at |

*FIG. 1 (continued)*

| NM_014128 |  | down | 220856_x_at |
|---|---|---|---|
| NM_024084 | MGC3196 | down | 220934_s_at |
| NM_005294 | GPR21 | down | 221294_at |
| AF077053 | PGK1 | down | 221616_s_at |
| NM_138387 | G6PC3 | up | 221759_at |
| NM_024531 | GPR172A | up | 222155_s_at |
| NM_000693 | ALDH1A3 | down | 222168_at |
| NM_018509 | PRO1855 | up | 222231_s_at |
| NM_033128 | SCIN | down | 222272_x_at |
| NM_020706 | SFRS15 | down | 222310_at |
| AI523613 | --- | down | 222358_x_at |
| NM_014884 | SFRS14 | down | 64371_at |

*FIG. 1 (continued)*

Table 2: 84 Gene Group

| GenBank ID (unless otherwise mentioned) | Gene Name | Description | Direction of Expression in Cancer | Exemplary probe: Affymetrix Id in the Human Genome U133 chip |
|---|---|---|---|---|
| NM_030757.1 | MKRN4 | makorin, ring finger protein, 4 /// makorin, ring finger protein, 4 | down | 208082_x_at |
| R83000 | BTF3 | basic transcription factor 3 | down | 214800_x_at |
| AK021571.1 | MUC20 | mucin 20 | down | 215208_x_at |
| NM_014182.1 | ORMDL2 | ORM1-like 2 (S. cerevisiae) | up | 218556_at |
| NM_17932.1 | FLJ20700 | hypothetical protein FLJ20700 | down | 207730_x_at |
| U85430.1 | NFATC3 | nuclear factor of activated T-cells, cytoplasmic, calcineurin-dependent 3 | down | 210556_at |
| AI683552 | --- | --- | down | 217679_x_at |
| BC002642.1 | CTSS | cathepsin S | down | 202901_x_at |
| AW024467 | RIPX | rap2 interacting protein x | down | 213939_s_at |
| NM_030972.1 | MGC5384 | hypothetical protein MGC5384 /// hypothetical protein MGC5384 | down | 208137_x_at |

*FIG. 2*

Table 2: 84 Gene Group

| GenBank ID (unless otherwise mentioned) | Gene Name | Description | Direction of Expression in Cancer | Exemplary probe: Affymetrix Id in the Human Genome U133 chip |
|---|---|---|---|---|
| BC021135.1 | INADL | InaD-like protein | down | 214705_at |
| AL161952.1 | GLUL | glutamate-ammonia ligase (glutamine synthase) | down | 215001_s_at |
| AK026565.1 | FLJ10534 | hypothetical protein FLJ10534 | down | 218155_x_at |
| AK023783.1 | --- | Homo sapiens cDNA FLJ13721 fis, clone PLACE2000450. | down | 215604_x_at |
| BF218804 | AFURS1 | ATPase family homolog up-regulated in senescence cells | down | 212297_at |
| NM_001281.1 | CKAP1 | cytoskeleton associated protein 1 | up | 201804_x_at |
| NM_024006.1 | IMAGE3455200 | hypothetical protein IMAGE3455200 | up | 217949_s_at |
| AK023843.1 | PGF | placental growth factor, vascular endothelial growth factor-related protein | down | 215179_x_at |
| BC001602.1 | CFLAR | CASP8 and FADD-like apoptosis regulator | down | 211316_x_at |

*FIG. 2 (continued)*

| Table 2: 84 Gene Group | | | | |
|---|---|---|---|---|
| GenBank ID (unless otherwise mentioned) | Gene Name | Description | Direction of Expression in Cancer | Exemplary probe: Affymetrix Id in the Human Genome U133 chip |
| BC034707.1 | --- | Homo sapiens transcribed sequence with weak similarity to protein ref:NP_060312.1 (H.sapiens) hypothetical protein FLJ20489 [Homo sapiens] | down | 217653_x_at |
| BC064619.1 | CD24 | CD24 antigen (small cell lung carcinoma cluster 4 antigen) | down | 266_s_at |
| AY280502.1 | EPHB6 | EphB6 | down | 204718_at |
| BC059387.1 | MYO1A | myosin IA | down | 211916_s_at |
| | --- | Homo sapiens transcribed sequences | down | 215032_at |
| AF135421.1 | GMPPB | GDP-mannose pyrophosphorylase B | up | 219920_s_at |
| BC061522.1 | MGC70907 | similar to MGC9515 protein | down | 211996_s_at |
| L76200.1 | GUK1 | guanylate kinase 1 | up | 200075_s_at |
| U50532.1 | CG005 | hypothetical protein from BCRA2 region | down | 214753_at |
| BC006547.2 | EEF2 | eukaryotic translation elongation factor 2 | down | 204102_s_at |
| BC008797.2 | FVT1 | follicular lymphoma variant translocation 1 | down | 202419_at |

*FIG. 2 (continued)*

| Table 2: 84 Gene Group | | | | |
|---|---|---|---|---|
| GenBank ID (unless otherwise mentioned) | Gene Name | Description | Direction of Expression in Cancer | Exemplary probe: Affymetrix Id in the Human Genome U133 chip |
| BC000807.1 | ZNF160 | zinc finger protein 160 | down | 214715_x_at |
| AL080112.1 | --- | --- | down | 216859_x_at |
| BC033718.1 /// BC046176.1 /// BC038443.1 | C21orf106 | chromosome 21 open reading frame 106 | down | 215529_x_at |
| NM_000346.1 | SOX9 | SRY (sex determining region Y)-box 9 (campomelic dysplasia, autosomal sex-reversal) | up | 202936_s_at |
| BC008710.1 | SUI1 | putative translation initiation factor | up | 212130_x_at |
| Hs.288575 (UNIGENE ID) | --- | Homo sapiens cDNA FLJ14090 fis, clone MAMMA1000264. | down | 215204_at |
| AF020591.1 | AF020591 | zinc finger protein | down | 218735_s_at |
| BC000423.2 | ATP6V0B | ATPase, H+ transporting, lysosomal 21kDa, V0 subunit c" /// ATPase, H+ transporting, lysosomal 21kDa, V0 subunit c" | up | 200078_s_at |
| BC002503.2 | SAT | spermidine/spermine N1-acetyltransferase | down | 203455_s_at |
| BC008710.1 | SUI1 | putative translation initiation factor | up | 212227_x_at |

*FIG. 2 (continued)*

| Table 2: 84 Gene Group | | | | |
|---|---|---|---|---|
| GenBank ID (unless otherwise mentioned) | Gene Name | Description | Direction of Expression in Cancer | Exemplary probe: Affymetrix Id in the Human Genome U133 chip |
| | --- | Homo sapiens transcribed sequences | down | 222282_at |
| BC009185.2 | DCLRE1C | DNA cross-link repair 1C (PSO2 homolog, S. cerevisiae) | down | 219678_x_at |
| Hs.528304 (UNIGENE ID) | ADAM28 | a disintegrin and metalloproteinase domain 28 | down | 208268_at |
| U50532.1 | CG005 | hypothetical protein from BCRA2 region | down | 221899_at |
| BC013923.2 | SOX2 | SRY (sex determining region Y)-box 2 | down | 213721_at |
| BC031091 | ODAG | ocular development-associated gene | down | 214718_at |
| NM_007062 | PWP1 | nuclear phosphoprotein similar to S. cerevisiae PWP1 | up | 201608_s_at |
| Hs.249591 (Unigene ID) | FLJ20686 | hypothetical protein FLJ20686 | down | 205684_s_at |
| BC075839.1 /// BC073760.1 | KRT8 | keratin 8 | up | 209008_x_at |
| BC072436.1 /// BC004560.2 | HYOU1 | hypoxia up-regulated 1 | up | 200825_s_at |
| BC001016.2 | NDUFA8 | NADH dehydrogenase (ubiquinone) 1 alpha subcomplex, 8, 19kDa | up | 218160_at |

FIG. 2 (continued)

Table 2: 84 Gene Group

| GenBank ID (unless otherwise mentioned) | Gene Name | Description | Direction of Expression in Cancer | Exemplary probe: Affymetrix Id in the Human Genome U133 chip |
|---|---|---|---|---|
| Hs.286261 (Unigene ID) | FLJ20195 | hypothetical protein FLJ20195 | down | 57739_at |
| AF348514.1 | --- | Homo sapiens fetal thymus prothymosin alpha mRNA, complete cds | down | 211921_x_at |
| BC005023.1 | CGI-128 | CGI-128 protein | up | 218074_at |
| BC066337.1 /// BC058736.1 /// BC050555.1 | KTN1 | kinectin 1 (kinesin receptor) | down | 200914_x_at |
| | --- | --- | down | 216384_x_at |
| Hs.216623 (Unigene ID) | ATP8B1 | ATPase, Class I, type 8B, member 1 | down | 214594_x_at |
| BC072400.1 | THOC2 | THO complex 2 | down | 222122_s_at |
| BC041073.1 | PRKX | protein kinase, X-linked | down | 204060_s_at |
| U43965.1 | ANK3 | ankyrin 3, node of Ranvier (ankyrin G) | down | 215314_at |
| | --- | --- | down | 208238_x_at |
| BC021258.2 | TRIM5 | tripartite motif-containing 5 | down | 210705_s_at |
| BC016057.1 | USH1C | Usher syndrome 1C (autosomal recessive, severe) | down | 211184_s_at |
| BC016713.1 /// BC014535.1 /// AF237771.1 | PARVA | parvin, alpha | down | 215418_at |

*FIG. 2 (continued)*

| Table 2: 84 Gene Group | | | | |
|---|---|---|---|---|
| GenBank ID (unless otherwise mentioned) | Gene Name | Description | Direction of Expression in Cancer | Exemplary probe: Affymetrix Id in the Human Genome U133 chip |
| BC000360.2 | EIF4EL3 | eukaryotic translation initiation factor 4E-like 3 | up | 209393_s_at |
| BC007455.2 | SH3GLB1 | SH3-domain GRB2-like endophilin B1 | up | 210101_x_at |
| BC000701.2 | KIAA0676 | KIAA0676 protein | down | 212052_s_at |
| BC010067.2 | CHC1 | chromosome condensation 1 | down | 215011_at |
| BC023528.2 /// BC047680.1 | C14orf87 | chromosome 14 open reading frame 87 | up | 221932_s_at |
| BC064957.1 | KIAA0102 | KIAA0102 gene product | up | 201239_s_at |
| Hs.156701 (Unigene ID) | --- | Homo sapiens cDNA FLJ14253 fis, clone OVARC1001376. | down | 215553_x_at |
| BC030619.2 | KIAA0779 | KIAA0779 protein | down | 213351_s_at |
| BC008710.1 | SUI1 | putative translation initiation factor | up | 202021_x_at |
| U43965.1 | ANK3 | ankyrin 3, node of Ranvier (ankyrin G) | down | 209442_x_at |
| BC066329.1 | SDHC | succinate dehydrogenase complex, subunit C, integral membrane protein, 15kDa | up | 210131_x_at |

*FIG. 2 (continued)*

| Table 2: 84 Gene Group | | | | |
|---|---|---|---|---|
| GenBank ID (unless otherwise mentioned) | Gene Name | Description | Direction of Expression in Cancer | Exemplary probe: Affymetrix Id in the Human Genome U133 chip |
| Hs.438867 (Unigene ID) | --- | Homo sapiens transcribed sequence with weak similarity to protein ref:NP_060312.1 (H.sapiens) hypothetical protein FLJ20489 [Homo sapiens] | down | 217713_x_at |
| BC035025.2 /// BC050330.1 | ALMS1 | Alstrom syndrome 1 | down | 214707_x_at |
| BC023976.2 | PDAP2 | PDGFA associated protein 2 | up | 203272_s_at |
| BC074852.2 /// BC074851.2 | PRKY | protein kinase, Y-linked | down | 206279_at |
| Hs.445885 (Unigene ID) | KIAA1217 | Homo sapiens cDNA FLJ12005 fis, clone HEMBB1001565. | down | 214912_at |
| BC008591.2 /// BC050440.1 /// BC048096.1 | KIAA0100 | KIAA0100 gene product | up | 201729_s_at |
| AF365931.1 | ZNF264 | zinc finger protein 264 | down | 205917_at |

*FIG. 2 (continued)*

| Table 2: 84 Gene Group | | | | |
|---|---|---|---|---|
| GenBank ID (unless otherwise mentioned) | Gene Name | Description | Direction of Expression in Cancer | Exemplary probe: Affymetrix Id in the Human Genome U133 chip |
| AF257099.1 | PTMA | prothymosin, alpha (gene sequence 28) | down | 200772_x_at |
| BC028912.1 | DNAJB9 | DnaJ (Hsp40) homolog, subfamily B, member 9 | up | 202842_s_at |

*FIG. 2 (continued)*

| Table 3: 50 Gene Group | | | |
|---|---|---|---|
| GenBank ID | Gene Name | Direction of Expression in Cancer | Exemplary probe: Affymetrix Id in the Human Genome U133 chip |
| NM_007062.1 | PWP1 | up in cancer | 201608_s_at |
| NM_001281.1 | CKAP1 | up in cancer | 201804_x_at |
| BC000120.1 | | up in cancer | 202355_s_at |
| NM_014255.1 | TMEM4 | up in cancer | 202857_at |
| BC002642.1 | CTSS | up in cancer | 202901_x_at |
| NM_000346.1 | SOX9 | up in cancer | 202936_s_at |
| NM_006545.1 | NPR2L | up in cancer | 203246_s_at |
| BG034328 | | up in cancer | 203588_s_at |
| NM_021822.1 | APOBEC3G | up in cancer | 204205_at |
| NM_021069.1 | ARGBP2 | up in cancer | 204288_s_at |
| NM_019067.1 | FLJ10613 | up in cancer | 205010_at |
| NM_017925.1 | FLJ20686 | up in cancer | 205684_s_at |
| NM_017932.1 | FLJ20700 | up in cancer | 207730_x_at |
| NM_030757.1 | MKRN4 | up in cancer | 208082_x_at |
| NM_030972.1 | MGC5384 | up in cancer | 208137_x_at |
| AF126181.1 | BCG1 | up in cancer | 208682_s_at |
| U93240.1 | | up in cancer | 209653_at |
| U90552.1 | | up in cancer | 209770_at |
| AF151056.1 | | up in cancer | 210434_x_at |
| U85430.1 | NFATC3 | up in cancer | 210556_at |
| U51007.1 | | up in cancer | 211609_x_at |
| BC005969.1 | | up in cancer | 211759_x_at |
| NM_002271.1 | | up in cancer | 211954_s_at |
| AL566172 | | up in cancer | 212041_at |
| AB014576.1 | KIAA0676 | up in cancer | 212052_s_at |
| BF218804 | AFURS1 | down in cancer | 212297_at |

*FIG. 3*

| Table 3: 50 Gene Group | | | |
|---|---|---|---|
| GenBank ID | Gene Name | Direction of Expression in Cancer | Exemplary probe: Affymetrix Id in the Human Genome U133 chip |
| AK022494.1 | | down in cancer | 212932_at |
| AA114843 | | down in cancer | 213884_s_at |
| BE467941 | | down in cancer | 214153_at |
| NM_003541.1 | HIST1H4K | down in cancer | 214463_x_at |
| R83000 | BTF3 | down in cancer | 214800_x_at |
| AL161952.1 | GLUL | down in cancer | 215001_s_at |
| AK023843.1 | PGF | down in cancer | 215179_x_at |
| AK021571.1 | MUC20 | down in cancer | 215208_x_at |
| AK023783.1 | --- | down in cancer | 215604_x_at |
| AU147182 | | down in cancer | 215620_at |
| AL080112.1 | --- | down in cancer | 216859_x_at |
| AW971983 | | down in cancer | 217588_at |
| AI683552 | --- | down in cancer | 217679_x_at |
| NM_024006.1 | IMAGE3455200 | down in cancer | 217949_s_at |
| AK026565.1 | FLJ10534 | down in cancer | 218155_x_at |
| NM_014182.1 | ORMDL2 | down in cancer | 218556_at |
| NM_021800.1 | DNAJC12 | down in cancer | 218976_at |
| NM_016049.1 | CGI-112 | down in cancer | 219203_at |
| NM_019023.1 | PRMT7 | down in cancer | 219408_at |
| NM_021971.1 | GMPPB | down in cancer | 219920_s_at |
| NM_014128.1 | --- | down in cancer | 220856_x_at |
| AK025651.1 | | down in cancer | 221648_s_at |
| AA133341 | C14orf87 | down in cancer | 221932_s_at |
| AF198444.1 | | down in cancer | 222168_at |

*FIG. 3 (continued)*

| Table 4: 36 Gene Group | | | |
|---|---|---|---|
| GenBank ID | Gene Name | Gene Description | Exemplary probe: Affymetrix Id in the Human Genome U133 chip |
| NM_007062.1 | PWP1 | nuclear phosphoprotein similar to S. cerevisiae PWP1 | 201608_s_at |
| NM_001281.1 | CKAP1 | cytoskeleton associated protein 1 | 201804_x_at |
| BC002642.1 | CTSS | cathepsin S | 202901_x_at |
| NM_000346.1 | SOX9 | SRY (sex determining region Y)-box 9 (campomelic dysplasia, autosomal sex-reversal) | 202936_s_at |
| NM_006545.1 | NPR2L | homologous to yeast nitrogen permease (candidate tumor suppressor) | 203246_s_at |
| BG034328 | | transcription factor Dp-2 (E2F dimerization partner 2) | 203588_s_at |
| NM_019067.1 | FLJ10613 | hypothetical protein FLJ10613 | 205010_at |
| NM_017925.1 | FLJ20686 | hypothetical protein FLJ20686 | 205684_s_at |
| NM_017932.1 | FLJ20700 | hypothetical protein FLJ20700 | 207730_x_at |
| NM_030757.1 | MKRN4 | makorin, ring finger protein, 4 /// makorin, ring finger protein, 4 | 208082_x_at |
| NM_030972.1 | MGC5384 | hypothetical protein MGC5384 | 208137_x_at |

*FIG. 4*

Table 4: 36 Gene Group

| GenBank ID | Gene Name | Gene Description | Exemplary probe: Affymetrix Id in the Human Genome U133 chip |
|---|---|---|---|
| NM_002268 /// NM_032771 | KPNA4 | karyopherin alpha 4 (importin alpha 3) | 209653_at |
| NM_007048 /// NM_194441 | BTN3A1 | butyrophilin, subfamily 3, member A1 | 209770_at |
| NM_006694 | JBT | jumping translocation breakpoint | 210434_x_at |
| U85430.1 | NFATC3 | nuclear factor of activated T-cells, cytoplasmic, calcineurin-dependent 3 | 210556_at |
| NM_004691 | ATP6V0D1 | ATPase, H+ transporting, lysosomal 38 kDa, V0 subunit d isoform 1 | 212041_at |
| AB014576.1 | KIAA0676 | KIAA0676 protein | 212052_s_at |
| BF218804 | AFURS1 | ATPase family homolog up-regulated in senescence cells | 212297_at |
| BE467941 | | EVOVL family member 5, elongation of long chain fatty acids (FEN1/Elo2, SUR4/Elo3-like, yeast) | 214153_at |
| R83000 | BTF3 | basic transcription factor 3 | 214800_x_at |
| AL161952.1 | GLUL | glutamate-ammonia ligase (glutamine synthase) | 215001_s_at |
| AK023843.1 | PGF | placental growth factor, vascular endothelial growth factor-related protein | 215179_x_at |
| AK021571.1 | MUC20 | mucin 20 | 215208_x_at |

*FIG. 4 (continued)*

| Table 4: 36 Gene Group | | | |
|---|---|---|---|
| GenBank ID | Gene Name | Gene Description | Exemplary probe: Affymetrix Id in the Human Genome U133 chip |
| AK023783.1 | --- | Homo sapiens cDNA FLJ13721 fis, clone PLACE2000450. | 215604_x_at |
| AL080112.1 | --- | --- | 216859_x_at |
| AW971983 | | cation, sperm associated 2 | 217588_at |
| AI683552 | --- | --- | 217679_x_at |
| NM_024006.1 | IMAGE3455200 | hypothetical protein IMAGE3455200 | 217949_s_at |
| AK026565.1 | FLJ10534 | hypothetical protein FLJ10534 | 218155_x_at |
| NM_014182.1 | ORMDL2 | ORM1-like 2 (S. cerevisiae) | 218556_at |
| NM_021800.1 | DNAJC12 | J Domain containing protein 1 | 218976_at |
| NM_016049.1 | CGI-112 | comparative gene identification transcript 112 | 219203_at |
| NM_021971.1 | GMPPB | GDP-mannose pyrophosphorylase B | 219920_s_at |
| NM_014128.1 | --- | --- | 220856_x_at |
| AA133341 | C14orf87 | chromosome 14 open reading frame 87 | 221932_s_at |
| AF198444.1 | | Homo sapiens 10q21 mRNA sequence | 222168_at |

DIAGNOSTIC FOR LUNG DISORDERS USING CLASS PREDICTION

CROSS-REFERENCE TO RELATED APPLICATIONS

Related Applications

The present application is a continuation of U.S. application Ser. No. 13/524,749, filed on Jun. 15, 2012, which is a continuation of U.S. application Ser. No. 12/869,525, filed on Aug. 26, 2010, which is a continuation of U.S. application Ser. No. 11/918,588, filed Feb. 8, 2008, which is a national stage filing under 35 U.S.C. 371 of International Application PCT/US2006/014132, filed Apr. 14, 2006, which claims the benefit of priority under 35 U.S.C. 119(e) to U.S. provisional application Ser. No. 60/671,243, filed on Apr. 14, 2005, the contents of which is are herein incorporated by reference in their entirety. International Application PCT/US2006/014132 was published under PCT Article 21(2) in English.

GOVERNMENT FUNDING

This invention was made with Government Support under Contract No. HL 071771 awarded by the National Institutes of Health. The Government has certain rights in the invention.

BACKGROUND OF THE INVENTION

Field of the Invention

The present invention is directed to diagnostic and prognostic methods by using analysis of gene group expression patterns in a subject. More specifically, the invention is directed to diagnostic and prognostic methods for detecting lung diseases, particularly lung cancer in subjects, preferably humans that have been exposed to air pollutants.

Background

Lung disorders represent a serious health problem in the modern society. For example, lung cancer claims more than 150,000 lives every year in the United States, exceeding the combined mortality from breast, prostate and colorectal cancers. Cigarette smoking is the most predominant cause of lung cancer. Presently, 25% of the U.S. population smokes, but only 10% to 15% of heavy smokers develop lung cancer. There are also other disorders associated with smoking such as emphysema. There are also health questions arising from people exposed to smokers, for example, second hand smoke. Former smokers remain at risk for developing such disorders including cancer and now constitute a large reservoir of new lung cancer cases. In addition to cigarette smoke, exposure to other air pollutants such as asbestos, and smog, pose a serious lung disease risk to individuals who have been exposed to such pollutants.

Approximately 85% of all subjects with lung cancer die within three years of diagnosis. Unfortunately survival rates have not changed substantially of the past several decades. This is largely because there are no effective methods for identifying smokers who are at highest risk for developing lung cancer and no effective tools for early diagnosis.

The methods that are currently employed to diagnose lung cancer include chest X-ray analysis, bronchoscopy or sputum cytological analysis, computer tomographic analysis of the chest, and positron electron tomographic (PET) analysis. However, none of these methods provide a combination of both sensitivity and specificity needed for an optimal diagnostic test.

Classification of human lung cancer by gene expression profiling has been described in several recent publications (M. Garber, "Diversity of gene expression in adenocarcinoma of the lung," PNAS, 98(24): 13784-13789 (2000); A. Bhattacharjee, "Classification of human lung carcinomas by mRNA expression profiling reveals distinct adenocarcinoma subclasses," PNAS, 98(24):13790-13795 (2001)), but no specific gene set is used as a classifier to diagnose lung cancer in bronchial epithelial tissue samples.

Moreover, while it appears that a subset of smokers are more susceptible to, for example, the carcinogenic effects of cigarette smoke and are more likely to develop lung cancer, the particular risk factors, and particularly genetic risk factors, for individuals have gone largely unidentified. Same applies to lung cancer associated with, for example, asbestos exposure.

Therefore, there exists a great need to develop sensitive diagnostic methods that can be used for early diagnosis and prognosis of lung diseases, particularly in individuals who are at risk of developing lung diseases, particularly individuals who are exposed to air pollutants such as cigarette/cigar smoke, asbestos and other toxic air pollutants.

SUMMARY OF THE INVENTION

The present invention provides compositions and methods for diagnosis and prognosis of lung diseases which provides a diagnostic test that is both very sensitive and specific.

We have found a group of gene transcripts that we can use individually and in groups or subsets for enhanced diagnosis for lung diseases, such as lung cancer, using gene expression analysis. We provide detailed guidance on the increase and/or decrease of expression of these genes for diagnosis and prognosis of lung diseases, such as lung cancer.

One example of the gene transcript groups useful in the diagnostic/prognostic tests of the invention are set forth in Table 6. We have found that taking groups of at least 20 of the Table 6 genes provides a much greater diagnostic capability than chance alone.

Preferably one would use more than 20 of these gene transcript, for example about 20-100 and any combination between, for example, 21, 22, 23, 24, 25, 26, 27, 28, 29, 30, and so on. Our preferred groups are the groups of 96 (Table 1), 84 (Table 2), 50 (Table 3), 36 (Table 4), 80 (Table 5), 535 (Table 6) and 20 (Table 7). In some instances, we have found that one can enhance the accuracy of the diagnosis by adding certain additional genes to any of these specific groups. When one uses these groups, the genes in the group are compared to a control or a control group. The control groups can be non-smokers, smokers, or former smokers. Preferably, one compares the gene transcripts or their expression product in the biological sample of an individual against a similar group, except that the members of the control groups do not have the lung disorder, such as emphysema or lung cancer. For example, comparing can be performed in the biological sample from a smoker against a control group of smokers who do not have lung cancer. When one compares the transcripts or expression products against the control for increased expression or decreased expression, which depends upon the particular gene and is set forth in the tables—not all the genes surveyed will show an increase or decrease. However, at least 50% of the genes surveyed must provide the described pattern. Greater reliability if obtained as the percent approaches 100%. Thus, in one embodiment, one wants at least 55%, 60%, 65%, 70%, 75%, 80%, 85%, 90%, 95%, 98%, or 99% of the genes surveyed to show the altered pattern indicative of lung disease, such as lung cancer, as set forth in the tables, infra.

In one embodiment, the invention provides a group of genes the expression of which is altered in individuals who are at risk of developing lung diseases, such as lung cancer, because of the exposure to air pollutants. The invention also provides groups of genes the expression of which is consistently altered as a group in individuals who are at risk of developing lung diseases because of the exposure to air pollutants.

The present invention provides gene groups the expression pattern or profile of which can be used in methods to diagnose lung diseases, such as lung cancer and even the type of lung cancer, in more than 60%, preferably more than 65%, still more preferably at least about 70%, still more preferably about 75%, or still more preferably about 80%-95% accuracy from a sample taken from airways of an individual screened for a lung disease, such as lung cancer.

In one embodiment, the invention provides a method of diagnosing a lung disease such as lung cancer using a combination of bronchoscopy and the analysis of gene expression pattern of the gene groups as described in the present invention.

Accordingly, the invention provides gene groups that can be used in diagnosis and prognosis of lung diseases. Particularly, the invention provides groups of genes the expression profile of which provides a diagnostic and or prognostic test to determine lung disease in an individual exposed to air pollutants. For example, the invention provides groups of genes the expression profile of which can distinguish individuals with lung cancer from individuals without lung cancer.

In one embodiment, the invention provides an early asymptomatic screening system for lung cancer by using the analysis of the disclosed gene expression profiles. Such screening can be performed, for example, in similar age groups as colonoscopy for screening colon cancer. Because early detection in lung cancer is crucial for efficient treatment, the gene expression analysis system of the present invention provides a vastly improved method to detect tumor cells that cannot yet be discovered by any other means currently available.

The probes that can be used to measure expression of the gene groups of the invention can be nucleic acid probes capable of hybridizing to the individual gene/transcript sequences identified in the present invention, or antibodies targeting the proteins encoded by the individual gene group gene products of the invention. The probes are preferably immobilized on a surface, such as a gene or protein chip so as to allow diagnosis and prognosis of lung diseases in an individual.

In one embodiment, the invention provides a group of genes that can be used as individual predictors of lung disease. These genes were identified using probabilities with a t-test analysis and show differential expression in smokers as opposed to non-smokers. The group of genes comprise ranging from 1 to 96, and all combinations in between, for example 5, 10, 15, 20, 25, 30, for example at least 36, at least about, 40, 45, 50, 60, 70, 80, 90, or 96 gene transcripts, selected from the group consisting of genes identified by the following GenBank sequence identification numbers (the identification numbers for each gene are separated by ";" while the alternative GenBank ID numbers are separated by "///"): NM_003335; NM_000918; NM_006430.1; NM_001416.1; NM_004090; NM_006406.1; NM_003001.2; NM_001319; NM_006545.1; NM_021145.1; NM_002437.1; NM_006286; NM_001003698 /// NM_001003699 /// NM_002955; NM_001123 /// NM_006721; NM_024824; NM_004935.1; NM_002853.1; NM_019067.1; NM_024917.1; NM_020979.1; NM_005597.1; NM_007031.1; NM_009590.1; NM_020217.1; NM_025026.1; NM_014709.1; NM_014896.1; AF010144; NM_005374.1; NM_001696; NM_005494 /// NM_058246; NM_006534 /// NM_181659; NM_006368; NM_002268 /// NM_032771; NM_014033; NM_016138; NM_007048 /// NM_194441; NM_006694; NM_000051 /// NM_138292 /// NM_138293; NM_000410 /// NM_139002 /// NM_139003 /// NM_139004 /// NM_139005 /// NM_139006 /// NM_139007 /// NM_139008 /// NM_139009 /// NM_139010 /// NM_139011; NM_004691; NM_012070 /// NM_139321 /// NM_139322; NM_006095; AI632181; AW024467; NM_021814; NM_005547.1; NM_203458; NM_015547 /// NM_147161; AB007958.1; NM_207488; NM_005809 /// NM_181737 /// NM_181738; NM_016248 /// NM_144490; AK022213.1; NM_005708; NM_207102; AK023895; NM_144606 /// NM_144997; NM_018530; AK021474; U43604.1; AU147017; AF222691.1; NM_015116; NM_001005375 /// NM_001005785 /// NM_001005786 /// NM_004081 /// NM_020363 /// NM_020364 /// NM_020420; AC004692; NM_001014; NM_000585 /// NM_172174 /// NM_172175; NM_054020 /// NM_172095 /// NM_172096 /// NM_172097; BE466926; NM_018011; NM_024077; NM_012394; NM_019011 /// NM_207111 /// NM_207116; NM_017646; NM_021800; NM_016049; NM_014395; NM_014336; NM_018097; NM_019014; NM_024804; NM_018260; NM_018118; NM_014128; NM_024084; NM_005294; AF077053; NM_138387; NM_024531; NM_000693; NM_018509; NM_033128; NM_020706; AI523613; and NM_014884, the expression profile of which can be used to diagnose lung disease, for example lung cancer, in lung cell sample from a smoker, when the expression pattern is compared to the expression pattern of the same group of genes in a smoker who does not have or is not at risk of developing lung cancer.

In another embodiment, the gene/transcript analysis comprises a group of about 10-20, 20-30, 30-40, 40-50, 50-60, 60-70, 70-80, 80, 80-90, 90-100, 100-120, 120-140, 140-150, 150-160, 160-170, 170-180, 180-190, 190-200, 200-210, 210-220, 220-230, 230-240, 240-250, 250-260, 260-270, 270-280, 280-290, 290-300, 300-310, 310-320, 320-330, 330-340, 340-350, 350-360, 360-370, 370-380, 380-390, 390-400, 400-410, 410-420, 420-430, 430-440, 440-450, 450-460, 460-470, 470-480, 480-490, 490-500, 500-510, 510-520, 520-530, and up to about 535 genes selected from the group consisting of genes or transcripts as shown in the Table 6.

In one embodiment, the genes are selected from the group consisting of genes or transcripts as shown in Table 5.

In another embodiment, the genes are selected from the genes or transcripts as shown in Table 7.

In one embodiment, the transcript analysis gene group comprises a group of individual genes the change of expression of which is predictive of a lung disease either alone or as a group, the gene transcripts selected from the group consisting of NM_007062.1; NM_001281.1; BC002642.1; NM_000346.1; NM_006545.1; BG034328; NM_019067.1; NM_017925.1; NM_017932.1; NM_030757.1; NM_030972.1; NM_002268 /// NM_032771;

NM_007048 /// NM_194441; NM_006694; U85430.1; NM_004691; AB014576.1; BF218804; BE467941; R83000; AL161952.1; AK023843.1; AK021571.1; AK023783.1; AL080112.1; AW971983; AI683552; NM_024006.1; AK026565.1; NM_014182.1; NM_021800.1; NM_016049.1; NM_021971.1; NM_014128.1; AA133341; AF198444.1.

In one embodiment, the gene group comprises a probe set capable of specifically hybridizing to at least all of the 36 gene products. Gene product can be mRNA which can be recognized by an oligonucleotide or modified oligonucleotide probe, or protein, in which case the probe can be, for example an antibody specific to that protein or an antigenic epitope of the protein.

In yet another embodiment, the invention provides a gene group, wherein the expression pattern of the group of genes provides diagnostic for a lung disease. The gene group comprises gene transcripts encoded by a gene group consisting of at least for example 5, 10, 15, 20, 25, 30, preferably at least 36, still more preferably 40, still more preferably 45, and still more preferably 46, 47, 48, 49, or all 50 of the genes selected from the group consisting of and identified by their GenBank identification numbers: NM_007062.1; NM_001281.1; BC000120.1; NM_014255.1; BC002642.1; NM_000346.1; NM_006545.1; BG034328; NM_021822.1; NM_021069.1; NM_019067.1; NM_017925.1; NM_017932.1; NM_030757.1; NM_030972.1; AF126181.1; U 93240.1; U90552.1; AF151056.1; U85430.1; U51007.1; BC005969.1; NM_002271.1; AL566172; AB014576.1; BF218804; AK022494.1; AA114843; BE467941; NM_003541.1; R83000; AL161952.1; AK023843.1; AK021571.1; AK023783.1; AU147182; AL080112.1; AW971983; AI683552; NM_024006.1; AK026565.1; NM_014182.1; NM_021800.1; NM_016049.1; NM_019023.1; NM_021971.1; NM_014128.1; AK025651.1; AA133341; and AF198444.1. In one preferred embodiment, one can use at least 20 of the 36 genes that overlap with the individual predictors and, for example, 5-9 of the non-overlapping genes and combinations thereof.

In another embodiment, the invention provides a group of about 30-180, preferably, a group of about 36-150 genes, still more preferably a group of about 36-100, and still more preferably a group of about 36-50 genes, the expression profile of which is diagnostic of lung cancer in individuals who smoke.

In one embodiment, the invention provides a group of genes the expression of which is decreased in an individual having lung cancer. In one embodiment, the group of genes comprises at least 5-10, 10-15, 15-20, 20-25 genes selected from the group consisting of NM_000918; NM_006430.1; NM_001416.1; MM_004090; NM_006406.1; NM_003001.2; NM_006545.1; NM_002437.1; NM_006286; NM_001123 /// NM_006721; NM_024824; NM_004935.1; NM_001696; NM_005494 /// NM_058246; NM_006368; NM_002268 /// NM_032771; NM_006694; NM_004691; NM_012394; NM_021800; NM_016049; NM_138387; NM_024531; and NM_018509. One or more other genes can be added to the analysis mixtures in addition to these genes.

In another embodiment, the group of genes comprises genes selected from the group consisting of NM_014182.1; NM_001281.1; NM_024006.1; AF135421.1; L76200.1; NM_000346.1; BC008710.1; BC000423.2; BC008710.1; NM_007062; BC075839.1 ///BC073760.1; BG072436.1 /// BC004560.2; BC001016.2; BC005023.1; BC000360.2; BC007455.2; BC023528.2 /// BC047680.1; BC064957.1; BC008710.1; BC066329.1; BC023976.2; BC008591.2 /// BC050440. /// BC048096.1; and BC028912.1.

In yet another embodiment, the group of genes comprises genes selected from the group consisting of NM_007062.1; NM_001281.1; BC000120.1; NM_014255.1; BC002642.1; NM_000346.1; NM_006545.1; BG034328; NM_021822.1; NM_021069.1; NM_019067.1; NM_017925.1; NM_017932.1; NM_030757.1; NM_030972.1; AF126181.1; U93240.1; U90552.1; AF151056.1; U85430.1; U51007.1; BC005969.1; NM_002271.1; AL566172; and AB014576.1.

In one embodiment, the invention provides a group of genes the expression of which is increased in an individual having lung cancer. In one embodiment, the group of genes comprises genes selected from the group consisting of NM_003335; NM_001319; NM_21145.1; NM_001003698 /// NM_001003699 ///; NM_002955; NM_002853.1; NM_019067.1; NM_024917.1; NM_020979.1; NM_005597.1; NM_007031.1; NM_009590.1; NM_020217.1; NM_025026.1; NM_014709.1; NM_014896.1; AF010144; NM_005374.1; NM_006534 /// NM_181659; NM_014033; NM_016138; NM_007048 /// NM_194441; NM_000051 /// NM_138292 /// NM_138293; NM_000410 /// NM_139002 /// NM_139003 /// NM_139004 /// NM_139005 /// NM_139006 /// NM_139007 /// NM_139008 /// NM_139009 /// NM_139010 /// NM_139011; NM_012070 /// NM_139321 /// NM_139322; NM_006095; A1632181; AW024467; NM_021814; NM_005547.1; NM_203458; NM_015547 /// NM_147161, AB007958.1; NM_207488; NM_005809 /// NM_181737 /// NM_181738; NM_016248 /// NM_144490; AK022213.1; NM_005708; NM_207102; AK023895; NM_144606 /// NM_144997; NM_018530; AK021474; U43604.1; AU147017; AF222691.1; NM_015116; NM_001005375 /// NM 001005785 /// NM_001005786 /// NM_004081 /// NM_020363 /// NM_020364 /// NM_020420; AC004692; NM_001014; NM_000585 /// NM_172174 /// NM_172175; NM_054020 /// NM_172095 /// NM_172096 /// NM_172097; BE466926; NM_018011; NM_024077; NM_019011 /// NM_207111 /// NM_207116; NM_017646; NM_014395; NM_014336; NM_018097; NM_019014; NM_024804; NM_018260; NM_018118; NM_014128; NM_024084; NM_005294; AF077053; NM_000693; NM_033128; NM_020706; AI523613; and NM_014884.

In one embodiment, the group of genes comprises genes selected from the group consisting of NM_030757.1; R83000; AK021571.1; NM_17932.1; U85430.1; A1683552; BC002642.1; AW024467; NM_030972.1; BC021135.1; AL161952.1; AK026565.1; AK023783.1; BF218804; AK023843.1; BC001602.1; BC034707.1; BC064619.1; AY280502.1; BC059387.1; BC061522.1; U50532.1; BC006547.2; BC008797.2; BC000807.1; AL080112.1; BC033718.1 /// BC046176.1 ///; BC038443.1; Hs.288575 (UNIGENE ID); AF020591.1; BC002503.2; BC009185.2; Hs.528304 (UNIGENE ID); U50532.1; BC013923.2; BC031091; Hs.249591 (Unigene ID); Hs.286261 (Unigene ID); AF348514.1; BC066337.1 /// BC058736.1 /// BC050555.1; Hs.216623 (Unigene ID); BC072400.1; BC041073.1; U43965.1; BC021258.2; BC016057.1; BC016713.1 /// BC014535.1 /// AF237771.1; BC000701.2; BC010067.2; Hs.156701 (Unigene ID); BC030619.2; U43965.1; Hs.438867 (Unigene ID); BC035025.2 /// BC050330.1; BC074852.2 /// BC074851.2; Hs.445885 (Unigene ID); AF365931.1; and AF257099.1.

In one embodiment, the group of genes comprises genes selected from the group consisting of BF218804;

AK022494.1; AA114843; BE467941; NM_003541.1; R83000; AL161952.1; AK023843.1; AK021571.1; AK023783.1; AU147182; AL080112.1; AW971983; AI683552; NM_024006.1; AK026565.1; NM_014182.1; NM_021800.1; NM_016049.1; NM_019023.1; NM_021971.1; NM_014128.1; AK025651.1; AA133341; and AF198444.1.

In another embodiment, the invention provides a method for diagnosing a lung disease comprising obtaining a nucleic acid sample from lung, airways or mouth of an individual exposed to an air pollutant, analyzing the gene transcript levels of one or more gene groups provided by the present invention in the sample, and comparing the expression pattern of the gene group in the sample to an expression pattern of the same gene group in an individual, who is exposed to similar air pollutant but not having lung disease, such as lung cancer or emphysema, wherein the difference in the expression pattern is indicative of the test individual having or being at high risk of developing a lung disease. The decreased expression of one or more of the genes, preferably all of the genes including the genes listed on Tables 1-4 as "down" when compared to a control, and/or increased expression of one or more genes, preferably all of the genes listed on Tables 1-4 as "up" when compared to an individual exposed to similar air pollutants who does not have a lung disease, is indicative of the person having a lung disease or being at high risk of developing a lung disease, preferably lung cancer, in the near future and needing frequent follow ups to allow early treatment of the disease.

In one preferred embodiment, the lung disease is lung cancer. In one embodiment, the air pollutant is cigarette smoke.

Alternatively, the diagnosis can separate the individuals, such as smokers, who are at lesser risk of developing lung diseases, such as lung cancer by analyzing the expression pattern of the gene groups of the invention provides a method of excluding individuals from invasive and frequent follow ups.

Accordingly, the invention provides methods for prognosis, diagnosis and therapy designs for lung diseases comprising obtaining an airway sample from an individual who smokes and analyzing expression profile of the gene groups of the present invention, wherein an expression pattern of the gene group that deviates from that in a healthy age, race, and gender matched smoker, is indicative of an increased risk of developing a lung disease. Tables 1-4 indicate the expression pattern differences as either being down or up as compared to a control, which is an individual exposed to similar airway pollutant but not affected with a lung disease.

The invention also provides methods for prognosis, diagnosis and therapy designs for lung diseases comprising obtaining an airway sample from a non-smoker individual and analyzing expression profile of the gene groups of the present invention, wherein an expression pattern of the gene group that deviates from that in a healthy age, race, and gender matched smoker, is indicative of an increased risk of developing a lung disease.

In one embodiment, the analysis is performed from a biological sample obtained from bronchial airways.

In one embodiment, the analysis is performed from a biological sample obtained from buccal mucosa.

In one embodiment, the analysis is performed using nucleic acids, preferably RNA, in the biological sample.

In one embodiment, the analysis is performed analyzing the amount of proteins encoded by the genes of the gene groups of the invention present in the sample.

In one embodiment the analysis is performed using DNA by analyzing the gene expression regulatory regions of the groups of genes of the present invention using nucleic acid polymorphisms, such as single nucleic acid polymorphisms or SNPs, wherein polymorphisms known to be associated with increased or decreased expression are used to indicate increased or decreased gene expression in the individual. For example, methylation patterns of the regulatory regions of these genes can be analyzed.

In one embodiment, the present invention provides a minimally invasive sample procurement method for obtaining airway epithelial cell RNA that can be analyzed by expression profiling of the groups of genes, for example, by array-based gene expression profiling. These methods can be used to diagnose individuals who are already affected with a lung disease, such as lung cancer, or who are at high risk of developing lung disease, such as lung cancer, as a consequence of being exposed to air pollutants. These methods can also be used to identify further patterns of gene expression that are diagnostic of lung disorders/diseases, for example, cancer or emphysema, and to identify subjects at risk for developing lung disorders.

The invention further provides a gene group microarray consisting of one or more of the gene groups provided by the invention, specifically intended for the diagnosis or prediction of lung disorders or determining susceptibility of an individual to lung disorders.

In one embodiment, the invention relates to a method of diagnosing a disease or disorder of the lung comprising obtaining a sample, nucleic acid or protein sample, from an individual to be diagnosed; and determining the expression of group of identified genes in said sample, wherein changed expression of such gene compared to the expression pattern of the same gene in a healthy individual with similar life style and environment is indicative of the individual having a disease of the lung.

In one embodiment, the invention relates to a method of diagnosing a disease or disorder of the lung comprising obtaining at least two samples, nucleic acid or protein samples, in at least one time interval from an individual to be diagnosed; and determining the expression of the group of identified genes in said sample, wherein changed expression of at least about for example 5, 10, 15, 20, 25, 30, preferably at least about 36, 40, 50, 60, 70, 80, 90, 100, 110, 120, 130, 140, 150, 160, 170, or 180 of such genes in the sample taken later in time compared to the sample taken earlier in time is diagnostic of a lung disease.

In one embodiment, the disease of the lung is selected from the group consisting of asthma, chronic bronchitis, emphysema, primary pulmonary hypertension, acute respiratory distress syndrome, hypersensitivity pneumonitis, eosinophilic pneumonia, persistent fungal infection, pulmonary fibrosis, systemic sclerosis, idiopathic pulmonary hemosiderosis, pulmonary alveolar proteinosis, and lung cancer, such as adenocarcinoma, squamous cell carcinoma, small cell carcinoma, large cell carcinoma, and benign neoplasm of the lung (e.g., bronchial adenomas and hamartomas).

In a particular embodiment, the nucleic acid sample is RNA.

In a preferred embodiment, the nucleic acid sample is obtained from an airway epithelial cell. In one embodiment, the airway epithelial cell is obtained from a bronchoscopy or buccal mucosal scraping.

In one embodiment, individual to be diagnosed is an individual who has been exposed to tobacco smoke, an individual who has smoked, or an individual who currently smokes.

The invention also provides an array, for example, a microarray for diagnosis of a disease of the lung having immobilized thereon a plurality of oligonucleotides which hybridize specifically to genes of the gene groups which are differentially expressed in airways exposed to air pollutants, such as cigarette smoke, and have or are at high risk of developing lung disease, as compared to those individuals who are exposed to similar air pollutants and airways which are not exposed to such pollutants. In one embodiment, the oligonucleotides hybridize specifically to one allelic form of one or more genes which are differentially expressed for a disease of the lung. In a particular embodiment, the differentially expressed genes are selected from the group consisting of the genes shown in tables 1-4; preferably the group of genes comprises genes selected from the Table 3. In one preferred embodiment, the group of genes comprises the group of at least 20 genes selected from Table 3 and additional 5-10 genes selected from Tables 1 and 2. In one preferred embodiment, at least about 10 genes are selected from Table 4.

BRIEF DESCRIPTION OF FIGURES

FIG. 1 shows Table 1, which sets forth a listing a group of 96 genes, their expression profile in lung cancer as compared to an individual not having lung cancer but being exposed to similar environmental stress, i.e. air pollutant, in this example, cigarette smoke. These genes were identified using Student's t-test.

FIG. 2 shows Table 2, listing a group of 84 genes, their expression profile in lung cancer as compared to an individual not having lung cancer but being exposed to similar environmental stress, i.e. air pollutant, in this example, cigarette smoke. These genes were identified using Student's t-test.

FIG. 3 shows Table 3, listing a group of 50 genes, and their expression profile in lung cancer as compared using a class-prediction model to an individual not having lung cancer but being exposed to similar environmental stress, i.e. air pollutant, in this example, cigarette smoke.

FIG. 4 shows Table 4, listing a group of 36 genes, their expression profile in lung cancer as compared to an individual not having lung cancer but being exposed to similar environmental stress, i.e. air pollutant, in this example, cigarette smoke. This group of genes is a combination of predictive genes identified using both Student's t-test and class-prediction model.

FIG. 18A shows bronchoscopy results for the 129 patients in the study. Only 32 of the 60 patients that had a final diagnosis of cancer had bronchoscopies that were diagnostic of lung cancer. The remaining 97 samples had bronchoscopies that were negative for lung cancer including 5 that had a definitive alternate benign diagnosis. This resulted in 92 patients with non-diagnostic bronchoscopy that required further tests and/or clinical follow-up. FIG. 18B shows biomarker prediction results. 36 of the 92 patients with non-diagnostic bronchoscopies exhibited a gene expression profile that was positive for lung cancer. This resulted in 25 of 28 cancer patients with non-diagnostic bronchoscopies being predicted to have cancer. FIG. 18C shows combined test results. In a combined test where a positive test result from either bronchoscopy or gene expression is considered indicative of lung cancer a sensitivity of 95% (57 of 60 cancer patients) with only a 16% false positive rate (11 of 69 non-cancer patients) is achieved. The shading of each contingency table is reflective of the overall fraction of each sample type in each quadrant.

FIG. 19A includes only Non Small Cell cancer samples that could be staged using the TMN system (48 of the 60 total cancer samples). FIG. 19B includes samples that could be histologically classified as Adenocarcinoma, Squamous Cell Carcinoma and Small Cell Carcinoma (45 of the 60 total cancer samples).

DETAILED DESCRIPTION OF THE INVENTION

Figure 5:
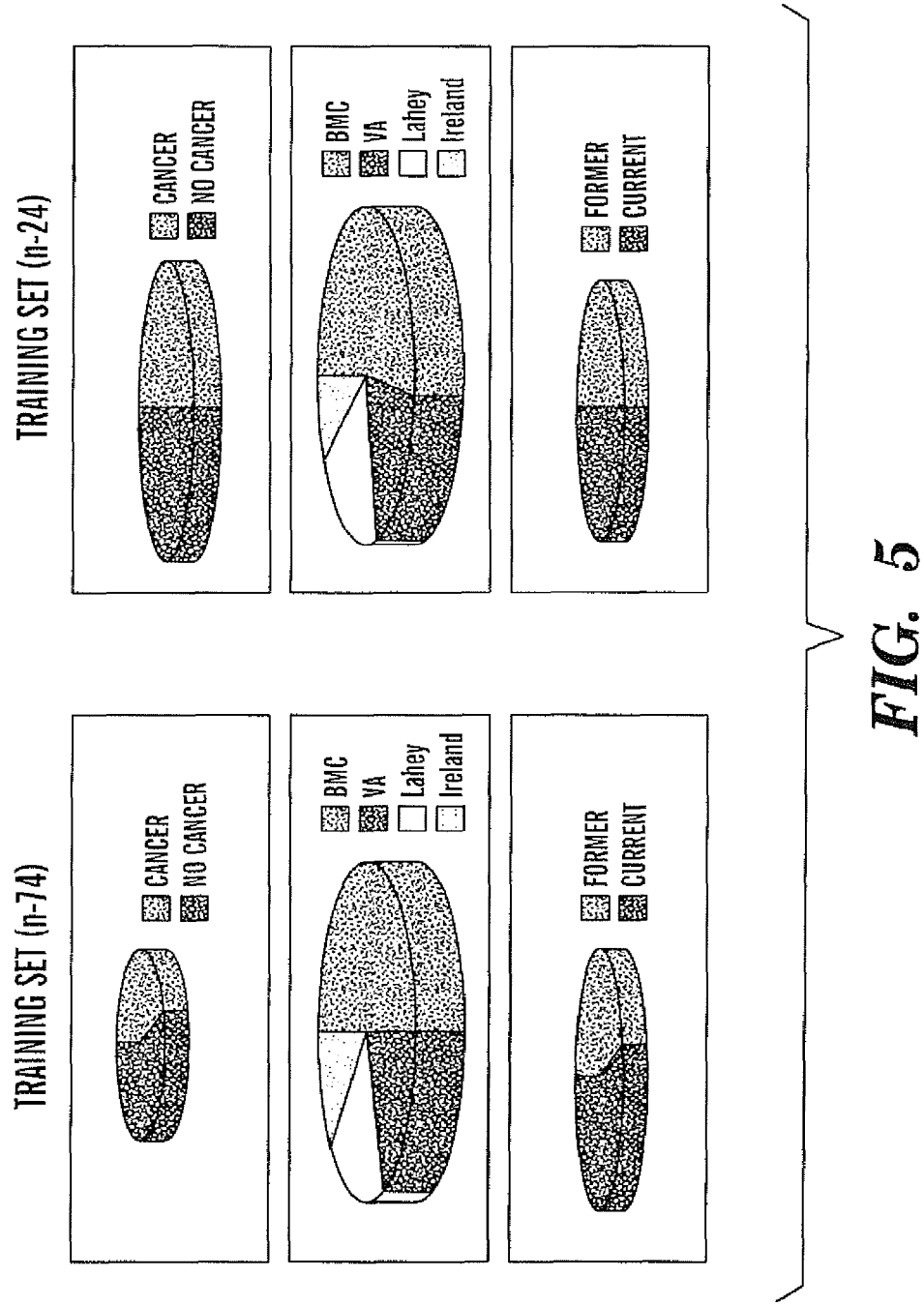
FIG. 5 shows an example of the results using class prediction model as obtained in Example 1. Training set included 74 samples, and the test set 24 samples. The mean age for the training set was 55 years, and the mean pack years smoked by the training set was 38. The mean age for the test set was 56 years, and the mean pack years smoked by the test set was 41.
Figure 6:
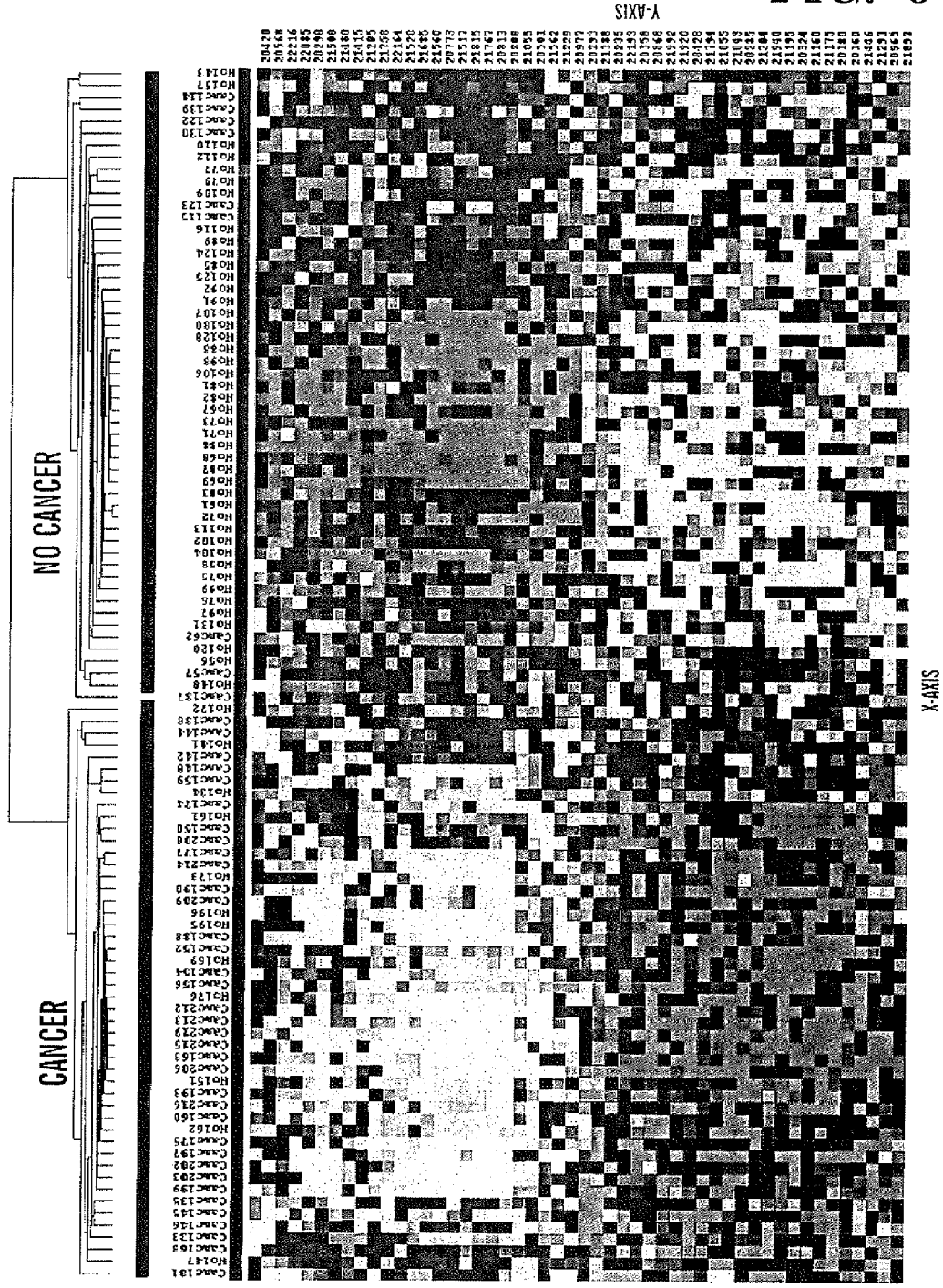
FIG. 6 shows an example of the 50 gene class prediction model obtained in Example 1. Each square represents expression of one transcript. The transcript can be identified by the probe identifier on the y-axis according to the Affymetrix Human Genome Gene chip U133 probe numbers (see Appendix). The individual samples are identified on the x-axis. The samples are shown in this figure as individuals with lung cancer ("cancer") and individuals without lung cancer ("no cancer"). The gene expression is shown as higher in darker squares and lower in lighter squares. One can clearly see the differences between the gene expression of these 50 genes in these two groups just by visually observing the pattern of lighter and darker squares.

The present invention is directed to gene/transcript groups and methods of using the expression profile of these gene/transcript groups in diagnosis and prognosis of lung diseases.

We provide a method that significantly increases the diagnostic accuracy of lung diseases, such as lung cancer. When one combines the gene expression analysis of the present invention with bronchoscopy, the diagnosis of lung cancer is dramatically better by detecting the cancer in an earlier stage than any other available method to date, and by providing far fewer false negatives and/or false positives than any other available method.

We have found a group of gene transcripts that we can use individually and in groups or subsets for enhanced diagnosis for lung diseases, such as lung cancer, using gene expression analysis. We provide detailed guidance on the increase and/or decrease of expression of these genes for diagnosis and prognosis of lung diseases, such as lung cancer.

One example of the gene transcript groups useful in the diagnostic/prognostic tests of the invention is set forth in Table 6. We have found that taking any group that has at least 20 of the Table 6 genes provides a much greater diagnostic capability than chance alone.

Preferably one would use more than 20 of these gene transcript, for example about 20-100 and any combination between, for example, 21, 22, 23, 24, 25, 26, 27, 28, 29, 30, and so on. Our preferred groups are the groups of 96 (Table 1), 84 (Table 2), 50 (Table 3), 36 (Table 4), 80 (Table 5), 535 (Table 6) and 20 (Table 7). In some instances, we have found that one can enhance the accuracy of the diagnosis by adding additional genes to any of these specific groups.

Naturally, following the teachings of the present invention, one may also include one or more of the genes and/or transcripts presented in Tables 1-7 into a kit or a system for a multicancer screening kit. For example, any one or more genes and or transcripts from Table 7 may be added as a lung cancer marker for a gene expression analysis.

When one uses these groups, the genes in the group are compared to a control or a control group. The control groups can be non-smokers, smokers, or former smokers. Preferably, one compares the gene transcripts or their expression product in the biological sample of an individual against a similar group, except that the members of the control groups do not have the lung disorder, such as emphysema or lung cancer. For example, comparing can be performed in the biological sample from a smoker against a control group of smokers who do not have lung cancer. When one compares the transcripts or expression products against the control for increased expression or decreased expression, which depends upon the particular gene and is set forth in the tables—not all the genes surveyed will show an increase or decrease. However, at least 50% of the genes surveyed must provide the described pattern. Greater reliability if obtained as the percent approaches 100%. Thus, in one embodiment, one wants at least 55%, 60%, 65%, 70%, 75%, 80%, 85%, 90%, 95%, 98%, 99% of the genes surveyed to show the altered pattern indicative of lung disease, such as lung cancer, as set forth in the tables as shown below.

The presently described gene expression profile can also be used to screen for individuals who are susceptible for lung cancer. For example, a smoker, who is over a certain age, for example over 40 years old, or a smoker who has smoked, for example, a certain number of years, may wish to be screened for lung cancer. The gene expression analysis as described herein can provide an accurate very early diagnosis for lung cancer. This is particularly useful in diagnosis of lung cancer, because the earlier the cancer is detected, the better the survival rate is.

For example, when we analyzed the gene expression results, we found, that if one applies a less stringent threshold, the group of 80 genes as presented in Table 5 are part of the most frequently chosen genes across 1000 statistical test runs (see Examples below for more details regarding the statistical testing). Using random data, we have shown that no random gene shows up more than 67 times out of 1000. Using such a cutoff, the 535 genes of Table 6 in our data show up more than 67 times out of 1000. All the 80 genes in Table 5 form a subset of the 535 genes. Table 7 shows the top 20 genes which are subset of the 535 list. The direction of change in expression is shown using signal to noise ratio. A negative number in Tables 5, 6, and 7 means that expression of this gene or transcript is up in lung cancer samples. Positive number in Table 5, 6, and 7, indicates that the expression of this gene or transcript is down in lung cancer.

Accordingly, any combination of the genes and/or transcripts of Table 6 can be used. In one embodiment, any combination of at least 5-10, 10-20, 20-30, 30-40, 40-50, 50-60, 60-70, 70-80, 80, 80-90, 90-100, 100-120, 120-140, 140-150, 150-160, 160-170, 170-180, 180-190, 190-200, 200-210, 210-220, 220-230, 230-240, 240-250, 250-260, 260-270, 270-280, 280-290, 290-300, 300-310, 310-320, 320-330, 330-340, 340-350, 350-360, 360-370, 370-380, 380-390, 390-400, 400-410, 410-420, 420-430, 430-440, 440-450, 450-460, 460-470, 470-480, 480-490, 490-500, 500-510, 510-520, 520-530, and up to about 535 genes selected from the group consisting of genes or transcripts as shown in the Table 6.

Table 7 provides 20 of the most frequently variably expressed genes in lung cancer when compared to samples without cancer. Accordingly, in one embodiment, any combination of about 3-5, 5-10, 11, 12, 13, 14, 15, 16, 17, 18, 19, or all 20 genes and/or transcripts of Table 7, or any subcombination thereof are used.

In one embodiment, the invention provides a gene group the expression profile of which is useful in diagnosing lung diseases and which comprises probes that hybridize ranging from 1 to 96 and all combinations in between for example 5, 10, 15, 20, 25, 30, 35, at least about 36, at least to 40, at least to 50, at least to 60, to at least 70, to at least 80, to at least 90, or all of the following 96 gene sequences: NM_003335; NM_000918; NM_006430.1; NM_001416.1; NM_004090; NM_006406.1; NM_003001.2; NM_001319; NM_006545.1; NM_021145.1; NM_002437.1; NM_006286; NM_001003698 /// NM_001003699 /// NM_002955; NM_001123 /// NM_006721; NM_024824; NM_004935.1; NM_002853.1; NM_019067.1; NM_024917.1; NM_020979.1; NM_005597.1; NM_007031.1; NM_009590.1; NM_020217.1; NM_025026.1; NM_014709.1; NM_014896.1; AF010144; NM_005374.1; NM_001696; NM_005494 /// NM_058246; NM_006534 /// NM_181659; NM_006368; NM_002268 /// NM_032771; NM_014033; NM_016138; NM_007048 /// NM_194441; NM_006694; NM_000051 /// NM_138292 /// NM_138293; NM_000410 /// NM_139002 /// NM_139003 /// NM_139004 /// NM_139005 /// NM_139006 /// NM_139007 /// NM_139008 /// NM_139009 /// NM_139010 /// NM_139011; NM_004691; NM_012070 /// NM_139321 /// NM_139322; NM_006095; NM_021814; NM_005547.1; NM_203458; NM_015547 /// NM_147161; AB007958.1; NM_207488; NM_005809 /// NM-181737 /// NM_181738; NM_016248 /// NM_144490; AK022213.1; NM_005708; NM_207102; AK023895; NM_144606 /// NM_144997; NM_018530; AK021474; U43604.1; AU147017; AF222691.1; NM_015116; NM_001005375 /// NM_001005785 /// NM_001005786 /// NM_004081 /// NM_020363 /// NM_020364 /// NM_020420; AC004692; NM_001014; NM_000585 /// NM_172174 /// NM_172175; NM_054020 /// NM_172095 /// NM_172096 /// NM_172097; BE466926; NM_018011; NM_024077; NM_012394; NM_019011 /// NM_207111 /// NM_207116; NM_017646; NM_021800; NK_016049; NM_014395; NM_014336; NM_018097; NM_019014; NM_024804; NK_018260; NM_018118; NM_014128; NK_024084; NM_005294; AF077053; NM_138387; NM_024531; NM_000693; NK_018509; NM_033128; NM_020706; AI523613; and NM_014884

In one embodiment, the invention provides a gene group the expression profile of which is useful in diagnosing lung diseases and comprises probes that hybridize to at least, for example, 5, 10, 15, 20, 25, 30, 35, at least about 36, at least to 40, at least to 50, at least to 60, to at least 70, to at least 80, to all of the following 84 gene sequences: NM_030757.1; R83000; AK021571.1; NM_014182.1; NM_17932.1; U85430.1; AI683552; BC002642.1; AW024467; NM_030972.1; BC021135.1; AL161952.1; AK026565.1; AK023783.1; BF218804; NM_001281.1; NM_024006.1; AK023843.1; BC001602.1; BC034707.1; BC064619.1; AY280502.1; BC059387.1; AF135421.1; BC061522.1; L76200.1; U50532.1; BC006547.2; BC008797.2; BC000807.1; AL080112.1; BC033718.1 /// BC046176.1 /// BC038443.1; NM_000346.1; BC008710.1; Hs.288575 (UNIGENE ID); AF020591.1; BC000423.2; BC002503.2; BC008710.1; BC009185.2; Hs.528304 (UNIGENE ID); U50532.1; BC013923.2; BC031091; NM_007062; Hs.249591 (Unigene ID); BC075839.1 /// BG073760.1; BC072436.1 ///BC004560.2; BC001016.2; Hs.286261 (Unigene ID); AF348514.1; BC005023.1; BC066337.1 ///BC058736.1 /// BC050555.1; Hs.216623 (Unigene ID); BC072400.1; BC041073.1; U43965.1; BC021258.2; BC016057.1; BC016713.1 /// BC014535.1 /// AF237771.1; BC000360.2; BC007455.2; BC000701.2; BC010067.2; BC023528.2 /// BC047680.1; BC064957.1; Hs.156701 (Unigene ID); BC030619.2; BC008710.1; U43965.1; BC066329.1; Hs.438867 (Unigene ID); BC035025.2 /// BC050330.1; BC023976.2; BC074852.2 /// BC074851.2; Hs.445885 (Unigene ID); BC008591.2 /// BC050440.1 ///; BC048096.1; AF365931.1; AF257099.1; and BC028912.1.

In one embodiment, the invention provides a gene group the expression profile of which is useful in diagnosing lung diseases and comprises probes that hybridize to at least, for example 5,10, 15, 20, 25, 30, preferably at least about 36, still more preferably at least to 40, still more preferably at least to 45, still more preferably all of the following 50 gene sequences, although it can include any and all members, for example, 20, 21, 22, up to and including 36: NM_007062.1; NM_001281.1; BC000120.1; NM_014255.1; BC002642.1; NM_000346.1; NM_006545.1; BG034328; NM_021822.1; NM_021069.1; NM_019067.1; NM_017925.1; NM_017932.1; NM_030757.1; NM_030972.1; AF126181.1; U93240.1; U90552.1; AF151056.1; U85430.1; U51007.1; BC005969.1; NM_002271.1; AL566172; AB014576.1; BF218804; AK022494.1; AA114843; BE467941; NM_003541.1; R83000; AL161952.1; AK023843.1; AK021571.1; AK023783.1; AU147182; AL080112.1; AW971983; AI683552; NM_024006.1; AK026565.1; NM_014182.1; NM_021800.1; NM_016049.1; NM_019023.1; NM_021971.1; NM_014128.1; AK025651.1; AA133341; and AF198444.1. In one preferred embodiment, one can use at least 20-30, 30-40, of the 50 genes that overlap with the individual predictor genes identified in the analysis using the t-test, and, for example, 5-9 of the non-overlapping genes, identified using the t-test analysis as individual predictor genes, and combinations thereof.

In one embodiment, the invention provides a gene group the expression profile of which is useful in diagnosing lung diseases and comprises probes that hybridize to at least for example 5, 10, 15, 20, preferably at least about 25, still more preferably at least to 30, still more preferably all of the following 36 gene sequences: NM_007062.1; NM_001281.1; BC002642.1; NM_000346.1; NM_006545.1; BG034328; NM_019067.1; NM_017925.1; NM_017932.1; NM_030757.1; NM_030972.1; NM-002268 /// NM_032771; NM_007048 /// NM_194441; NM_006694; U85430.1; NM_004691; AB014576.1; BF218804; BE467941; R83000; AL161952.1; AK023843.1; AK021571.1; AK023783.1; AL080112.1; AW971983; AI683552; NM_024006.1; AK026565.1; NM_014182.1; NM_021800.1; NM_016049.1; NM_021971.1; NM_014128.1; AA133341; and AF198444.1. In one preferred embodiment, one can use at least 20 of the 36 genes that overlap with the individual predictors and, for example, 5-9 of the non-overlapping genes, and combinations thereof.

The expression of the gene groups in an individual sample can be analyzed using any probe specific to the nucleic acid sequences or protein product sequences encoded by the gene group members. For example, in one embodiment, a probe set useful in the methods of the present invention is selected from the nucleic acid probes of between 10-15, 15-20, 20-180, preferably between 30-180, still more preferably between 36-96, still more preferably between 36-84, still more preferably between 36-50 probes, included in the Affymetrix Inc. gene chip of the Human Genome U133 Set and identified as probe ID Nos: 208082_x_at, 214800_x_at, 215208_x_at, 218556_at, 207730_x_at, 210556_at, 217679_x_at, 202901_x_at, 213939_s_at, 208137_x_at, 214705_at, 215001_s_at, 218155_x_at, 215604_x_at, 212297_at, 201804_x_at, 217949_s_at, 215179_x_at, 211316_x_at, 217653_x_at, 266_s_at, 204718_at, 211916_s_at, 215032_at, 219920_s_at, 211996_s_at, 200075_s_at, 214753_at, 204102_s_at, 202419_at, 214715_x_at, 216859_x_at, 215529_x_at, 202936_s_at, 212130_x_at, 215204_at, 218735_s_at, 200078_s_at, 203455_s_at, 212227_at, 222282_at, 219678_x_at, 208268_at, 221899_at, 213721_at, 214718_at, 201608_s_at, 205684_s_at, 209008_x_at, 200825_s_at, 218160_at, 57739_at, 211921_x_at, 218074_at, 200914_x_at, 216384_x_at, 214594_x_at, 222122_s_at, 204060_s_at, 215314_at, 208238_x_at, 210705_s_at, 211184_s_at, 215418_at, 209393_s_at, 210101_x_at, 212052_s_at, 215011_at, 221932_s_at, 201239_s_at, 215553_x_at, 213351_s_at, 202021_x_at, 209442_x_at, 210131_x_at, 217713_x_at, 214707_x_at, 203272_s_at, 206279_at, 214912_at, 201729_s_at, 205917_at, 200772_x_at, 202842_s_at, 203588_s_at, 209703_x_at, 217313_at, 217588_at, 214153_at, 222155_s_at, 203704_s_at, 220934_s_at, 206929_s_at, 220459_at, 215645_at, 217336_at, 203301_s_at, 207283_at, 222168_at, 222272_x_at, 219290_x_at, 204119_s_at, 215387_x_at, 222358_x_at, 205010_at, 1316_at, 216187_x_at, 208678_at, 222310_at, 210434_x_at, 220242_x_at, 207287_at, 207953_at, 209015_s_at, 221759_at, 220856_x_at, 200654_at, 220071_x_at, 216745_x_at, 218976_at, 214833_at, 202004_x_at, 209653_at, 210858_x_at, 212041_at, 221294_at, 207020_at, 204461_x_at, 207984_s_at, 215373_x_at, 216110_x_at, 215600_x_at, 216922_x_at, 215892_at, 201530_x_at, 217371_s_at, 222231_s_at, 218265_at, 201537_s_at, 221616_s_at, 213106_at, 215336_at, 209770_at, 209061_at, 202573_at, 207064_s_at, 64371_at, 219977_at, 218617_at, 214902_x_at, 207436_x_at, 215659_at, 204216_s_at, 214763_at, 200877_at, 218425_at, 203246_s_at, 203466_at, 204247_s_at, 216012_at, 211328_x_at, 218336_at, 209746_s_at, 214722_at, 214599_at, 220113_x_at, 213212_x_at, 217671_at, 207365_x_at, 218067_s_at, 205238_at, 209432_s_at, and 213919_at. In one preferred embodiment, one can use at least, for example, 10-20, 20-30, 30-40, 40-50, 50-60, 60-70, 70-80, 80-90, 90-100, 110, 120, 130, 140, 150, 160, or 170 of the 180 genes that overlap with the individual predictors genes and, for example, 5-9 of the non-overlapping genes and combinations thereof.

Sequences for the Affymetrix probes are provided in the Appendix to the specification, all the pages of which are herein incorporated by reference in their entirety.

One can analyze the expression data to identify expression patters associated with any lung disease that is caused by exposure to air pollutants, such as cigarette smoke, asbestos or any other lung disease. For example, the analysis can be performed as follows. One first scans a gene chip or mixture of beads comprising probes that are hybridized with a study group samples. For example, one can use samples of non-smokers and smokers, non-asbestos exposed individuals and asbestos-exposed individuals, non-smog exposed individuals and smog-exposed individuals, smokers without a lung disease and smokers with lung disease, to obtain the differentially expressed gene groups between individuals with no lung disease and individuals with lung disease. One must, of course select appropriate groups, wherein only one air pollutant can be selected as a variable. So, for example, one can compare non-smokers exposed to asbestos but not smog and non-smokers not exposed to asbestos or smog.

The obtained expression analysis, such as microarray or microbead raw data consists of signal strength and detection p-value. One normalizes or scales the data, and filters the poor quality chips/bead sets based on images of the expression data, control probes, and histograms. One also filters contaminated specimens which contain non-epithelial cells. Lastly, one filters the genes of importance using detection p-value. This results in identification of transcripts present in normal airways (normal airway transcriptome). Variability and multiple regression analysis can be used. This also results in identification of effects of smoking on airway epithelial cell transcription. For this analysis, one can use T-test and Pearson correlation analysis. One can also identify a group or a set of transcripts that are differentially expressed in samples with lung disease, such as lung cancer and samples without cancer. This analysis was performed using class prediction models.

For analysis of the data, one can use, for example, a weighted voting method. The weighted voting method ranks, and gives a weight "p" to all genes by the signal to noise ration of gene expression between two classes: $P=\text{mean}_{(class\ 1)}-\text{mean}_{(class\ 2)}\text{sd}_{(class\ 1)}=\text{sd}_{(class\ 2)}$. Committees of variable sizes of the top ranked genes are used to evaluate test samples, but genes with more significant p-values can be more heavily weighed. Each committee genes in test sample votes for one class or the other, based on how close that gene expression level is to the class 1 mean or the class 2 mean. $V_{(gene\ A)}=P_{(gene\ A)}$, i.e. level of expression in test sample less the average of the mean expression values in the two classes. Votes for each class are tallied and the winning class is determined along with prediction strength as $PS=V_{win}-V_{lose}/V_{win}+V_{lose}$. Finally, the accuracy can be validated using cross-validation +/- independent samples.

Table 1 shows 96 genes that were identified as a group distinguishing smokers with cancer from smokers without cancer. The difference in expression is indicated at the column on the right as either "down", which indicates that the expression of that particular transcript was lower in smokers with cancer than in smokers without cancer, and "up", which indicates that the expression of that particular transcript was higher in smokers with cancer than smokers without cancer. In one embodiment, the exemplary probes shown in the column "Affymetrix Id in the Human Genome U133 chip" can be used. Sequences for the Affymetrix probes are provided in the Appendix.

TABLE 1

96 Gene Group

| Affymetrix Id | GenBank ID | Gene Description | Gene Name | Direction in Cancer |
|---|---|---|---|---|
| 1316_at | NM_003335 | ubiquitin-activated enzyme E1-like | UBE1L | down |
| 200654_at | NM_000918 | procollagen-proline, 2-oxoglutarate 4-dioxygenase (proline 4-hydroxylase), beta polypeptide (protein disulfide isomerase; thyroid hormone binding protein p55) | P4HB | up |
| 200877_at | NM_006430.1 | chaperonin containing TCP1, subunit 4 (delta) | CCT4 | up |
| 201530_x_at | NM_001416.1 | eukaryotic translation factor 4A, isoform 1 | EIF4A1 | up |
| 201537_s_at | NM_004090 | dual specificity phosphatase 3 (vaccinia virus phosphatase VH1-related) | DUSP3 | up |
| 201923_at | NM_006406.1 | peroxiredoxin 4 | PRDX4 | up |
| 202004_x_at | NM_003001.2 | succinate dehydrogenase complex, subunit C, integral membrane protein, 15 kDa | SDHC | up |
| 202573_at | NM_001319 | casein kinase 1, gamma 2 | CSNK1G2 | down |
| 203246_s_at | NM_006545.1 | tumor suppressor candidate 4 | TUSC4 | up |
| 203301_s_at | NM_021145.1 | cyclin D binding myb-like transcription factor 1 | DMTF1 | down |
| 203466_at | NM_002437.1 | MpV17 transgene, murine homolog, glomerusclerosis | MPV17 | up |
| 203588_s_at | NM_006286 | transcription factor Dp-2 (E2F dimerization partner 2) | TFDP2 | up |
| 203704_s_at | NM_001003698 /// NM_001003699 /// NM_002955 | ras responsive element binding protein 1 | RREB1 | down |
| 204119_s_at | NM_001123 /// NM_006721 | adenosine kinase | ADK | up |
| 204216_s_at | NM_024824 | nuclear protein UKp68 | FLJ11806 | up |
| 204247_s_at | NM_004935.1 | cyclin-dependent kinase 5 | CDK5 | up |
| 204461_x_at | NM_002853.1 | RAD1 homolog | RAD1 | down |
| 205010_at | NM_019067.1 | hypothetical protein FLJ10613 | FLJ10613 | down |
| 205238_at | NM_024917.1 | chromosome X open reading frame 34 | CXorf34 | down |
| 205367_at | NM_020979.1 | adaptor protein with pleckstrin homology and src homology 2 domains | APS | down |
| 206929_s_at | NM_005597.1 | nuclear factor I/c (CCAAT-binding transcription factor) | NFIC | down |
| 207020_at | NM_007031.1 | heat shock transcription factor 2 binding protein | HSF2BP | down |
| 207064_s_at | NM_009590.1 | amine oxidase, copper containing 2 (retina-specific) | AOC2 | down |
| 207283_at | NM_020217.1 | hypothetical protein DKFZp547I014 | DKFZp547I014 | down |
| 207287_at | NM_025026.1 | hypothetical protein FLJ14107 | FLJ14107 | down |
| 207365_x_at | NM_014709.1 | ubiquitin specific protease 34 | USP34 | down |
| 207436_x_at | NM_014896.1 | KIAA0894 protein | KIAA0894 | down |
| 207953_at | AF010144 | — | — | down |
| 207984_s_at | NM_005374.1 | membrane protein, palmitoylated 2 (MAGUK p55 subfamily member2 | MPP2 | down |
| 208678_at | NM_001696 | ATPase, H+ transporting, lysosomal 31 kDa, V1 subunit E, isoform 1 | ATP6V1E1 | up |
| 209015_s_at | NM_005494 /// NM_058246 | DnaJ (Hsp40) homolog, subfamily B, member 6 | DNAJB6 | up |
| 209061_at | NM_006534 /// NM_181659 | nuclear receptor coactivator 3 | NCOA3 | down |
| 209432_s_at | NM_006368 | cAMP responsive element binding protein 3 | CREB3 | up |
| 209653_at | NM_002268 /// NM_032771 | karyopherin alpha 4 (importin alpha 3) | KPNA4 | up |
| 209703_x_at | NM_014033 | DKFZP586A0522 protein | DKFZP586A0522 | down |
| 209746_s_at | NM_016138 | coenzyme Q7 homolog, ubiquinone | COQ7 | down |
| 209770_at | NM_007048 /// NM_194441 | butyrophilin, subfamily 3, member A1 | BTN3A1 | down |
| 210434_x_at | NM_006694 | jumping translocation breakpoint | JTB | up |
| 210858_x_at | NM_000051 /// NM_138292 /// NM_138293 | ataxia telangiectasia mutated (includes complementation groups A, C, and D | ATM | down |
| 211328_x_at | NM_000410 /// NM_139002 /// NM_139003 /// | hemochromatosis | HFE | down |

TABLE 1-continued

96 Gene Group

| Affymetrix Id | GenBank ID | Gene Description | Gene Name | Direction in Cancer |
|---|---|---|---|---|
| | NM_139004 ///<br>NM_139005 ///<br>NM_139006 ///<br>NM_139007 ///<br>NM_139008 ///<br>NM_139009 ///<br>NM_139010 ///<br>NM_139011 | | | |
| 212041_at | NM_004691 | ATPase, H+ transporting, lysosomal 38 kDa, V0 subunit d isoform 1 | ATP6V0D1 | up |
| 212517_at | NM_012070 ///<br>NM_139321 ///<br>NM_139322 | attractin | ATRN | down |
| 213106_at | NM_006095 | ATPase, aminophospholipid transporter (APLT), Class I, type 8A, member 1 | ATP8A1 | down |
| 213212_x_at | AI632181 | Similar to FLJ40113 protein | — | down |
| 213919_at | AW024467 | — | — | down |
| 214153_at | NM_021814 | ELOVL family member 5, elongation of long chain fatty acids (FEN1/Elo2, SUR4/Elo3-like, yeast) | ELOVL5 | down |
| 214599_at | NM_005547.1 | involucrin | IVL | down |
| 214722_at | NM_203458 | similar to NOTCH2 protein | N2N | down |
| 214763_at | NM_015547 ///<br>NM_147161 | thiosterase, adipose associated | THEA | down |
| 214833_at | AB007958.1 | KIAA0792 gene product | KIAA0792 | down |
| 214902_x_at | NM_207488 | FLJ42393 protein | FLJ42393 | down |
| 215067_x_at | NM_005809 ///<br>NM_181737 ///<br>NM_181738 | peroxiredoxin 2 | PRDX2 | down |
| 215336_at | NM_016248 ///<br>NM_144490 | A kinase (PRKA) anchor protein | AKAP11 | down |
| 215373_x_at | AK022213.1 | hypothetical protein FLJ12151 | FLJ12151 | down |
| 215387_x_at | NM_005708 | Glypican 6 | GPC6 | down |
| 215600_x_at | NM_207102 | F-box and WD-40 domain protein 12 | FBXW12 | down |
| 215609_at | AK023895 | — | — | down |
| 215645_at | NM_144606 ///<br>NM_144997 | Hypothetical protein MGC13008 | FLCN | down |
| 215659_at | NM_018530 | Gasdermin-like | GSDML | down |
| 215892_at | AK021474 | — | — | down |
| 216012_at | U43604.1 | human unidentified mRNA, partial sequence | — | down |
| 216110_x_at | AU147017 | — | — | down |
| 216187_x_at | AF222691.1 | Homo sapiens Alu repeat | LNX1 | down |
| 216745_x_at | NM_015116 | Leucine-rich repeats and calponin homology (CH) domain containing 1 | LRCH1 | down |
| 216922_x_at | NM_001005375 ///<br>NM_001005785 ///<br>NM_001005786 ///<br>NM_004081 ///<br>NM_020363 ///<br>NM_020364 ///<br>NM_020420 | deleted in azoospermia | DAZ2 | down |
| 217313_at | AC004692 | — | — | down |
| 217336_at | NM_001014 | ribosomal protein S10 | RPS10 | down |
| 217371_s_at | NM_000585 ///<br>NM_172174 ///<br>NM_172175 | interleukin 15 | IL15 | down |
| 217588_at | NM_054020 ///<br>NM_172095 ///<br>NM_172096 ///<br>NM_172097 | cation channel, sperm associated 2 | CATSPER2 | down |
| 217671_at | BE466926 | — | — | down |
| 218067_s_at | NM_018011 | hypothetical protein FLJ10154 | FLJ10154 | down |
| 218265_at | NM_024077 | SECIS binding protein 2 | SECISBP2 | down |
| 218336_at | NM_012394 | prefoldin 2 | PFDN2 | up |
| 218425_at | NM_019411 ///<br>NM_207111 ///<br>NM_207116 | TRIAD3 protein | TRIAD3 | down |
| 218617_at | NM_017646 | tRNA isopentenyltransferase 1 | TRIT1 | down |
| 218976_at | NM_021800 | DnaJ (Hsp40) homolog, subfamily C, member 12 | DNAJC12 | up |
| 219203_at | NM_016049 | chromosome 14 open reading frame 122 | C14orf122 | up |
| 219290_x_at | NM_014395 | dual adaptor of phosphotyrosine and 3-phosphoinositides | DAPP1 | down |
| 219977_at | NM_014336 | aryl hydrocarbon receptor interacting protein-like 1 | AIPL1 | down |
| 220071_x_at | NM_018097 | chromosome 15 open reading frame 25 | C15orf25 | down |
| 220113_x_at | NM_019014 | polymerase (RNA) I polypeptide B, 128 kDa | POLR1B | down |
| 210215_at | NM_024804 | hypothetical protein FLJ12606 | FLJ12606 | down |
| 220242_x_at | NM_018260 | hypothetical protein FLJ10891 | FLJ10891 | down |
| 220459_at | NM_018118 | MCM3 minichromosome maintenace deficient 3 (s. cerevisiae) associated protein, antisense | MCM3APAS | down |
| 220856_x_at | NM_014128 | — | | down |

TABLE 1-continued

96 Gene Group

| Affymetrix Id | GenBank ID | Gene Description | Gene Name | Direction in Cancer |
|---|---|---|---|---|
| 220934_s_at | NM_024084 | hypothetical protein MGC3196 | MGC3196 | down |
| 221294_at | NM_005294 | G protein-coupled receptor 21 | GPR21 | down |
| 221616_s_at | AF077053 | Phosphoglycerate kinase 1 | PGK1 | down |
| 221759_at | NM_138387 | glucose-6-phosphatase catalytic subunit-related | G6PC3 | up |
| 222155_s_at | NM_024531 | G protein-coupled receptor 172A | GPR172A | up |
| 222168_at | NM_000693 | Aldehyde dehydrogenase 1 family, member A3 | ALDH1A3 | down |
| 222231_s_at | NM_018509 | hypothetical protein PRO1855 | PRO1855 | up |
| 222272_x_at | NM_033128 | scinderin | SCIN | down |
| 222310_at | NM_020706 | splicing factor, arginine/serine-rich 15 | SFRS15 | down |
| 222358_x_at | AI523613 | — | — | down |
| 64371_at | NM_014884 | splicing factor, arginine/serine-rich 14 | SFRS14 | down |

Table 2 shows one preferred 84 gene group that was identified as a group distinguishing smokers with cancer from smokers without cancer. The difference in expression is indicated at the column on the right as either "down", which indicates that the expression of that particular transcript was lower in smokers with cancer than in smokers without cancer, and "up", which indicates that the expression of that particular transcript was higher in smokers with cancer than smokers without cancer. These genes were identified using traditional Student's t-test analysis.

In one embodiment, the exemplary probes shown in the column "Affymetrix Id in the Human Genome U133 chip" can be used in the expression analysis.

TABLE 2

84 Gene Group

| GenBank ID (unless otherwise mentioned) | Gene Name | Description | Direction in Cancer | Affymetrix ID |
|---|---|---|---|---|
| NM_030757.1 | MKRN4 | makorin, ring finger protein, 4 /// makorin, ring finger protein, 4 | down | 208082_x_at |
| R83000 | BTF3 | basic transcription factor 3 | down | 214800_x_at |
| AK021571.1 | MUC20 | mucin 20 | down | 215208_x_at |
| NM_014182.1 | ORMDL2 | ORM1-like 2 (*S. cerevisiae*) | up | 218556_at |
| NM_17932.1 | FLJ20700 | hypothetical protein FLJ20700 | down | 207730_x_at |
| U85430.1 | NFATC3 | nuclear factor of activated T-cells, cytoplasmic, calcineurin-dependent 3 | down | 210556_at |
| AI683552 | — | — | down | 217679_x_at |
| BC002642.1 | CTSS | cathepsin S | down | 202901_x_at |
| AW024467 | RIPX | rap2 interacting protein x | down | 213939_s_at |
| NM_030972.1 | MGC5384 | hypothetical protein MGC5384 /// hypothetical protein MGC5384 | down | 208137_x_at |
| BC021135.1 | INADL | InaD-like protein | down | 214705_at |
| AL161952.1 | GLUL | glutamate-ammonia ligase (glutamine synthase) | down | 215001_s_at |
| AK026565.1 | FLJ10534 | hypothetical protein FLJ10534 | down | 218155_x_at |
| AK023783.1 | — | *Homo sapiens* cDNA FLJ13721 fis, clone PLACE2000450. | down | 215604_x_at |
| BF218804 | AFURS1 | ATPase family homolog up-regulated in senescence cells | down | 212297_at |
| NM_001281.1 | CKAP1 | cytoskeleton associated protein 1 | up | 201804_x_at |
| NM_024006.1 | IMAGE3455200 | hypothetical protein IMAGE3455200 | up | 217949_s_at |
| AK023843.1 | PGF | placental growth factor, vascular endothelial growth factor-related protein | down | 215179_x_at |
| BC001602.1 | CFLAR | CASP8 and FADD-like apoptosis regulator | down | 211316_x_at |
| BC034707.1 | — | *Homo sapiens* transcribed sequence with weak similarity to protein ref: NP_060312.1 (*H. sapiens*) hypothetical protein FLJ20489 [*Homo sapiens*] | down | 217653_x_at |
| BC064619.1 | CD24 | CD24 antigen (small cell lung carcinoma cluster 4 antigen) | down | 266_s_at |
| AY280502.1 | EPHB6 | EphB6 | down | 204718_at |
| BC059387.1 | MYO1A | myosin IA | down | 211916_s_at |
| | — | *Homo sapiens* transcribed sequences | down | 215032_at |
| AF135421.1 | GMPPB | GDP-mannose pyrophosphorylase B | up | 219920_x_at |
| BC061522.1 | MGC70907 | similar to MGC9515 protein | down | 211996_s_at |
| L76200.1 | GUK1 | guanylate kinase 1 | up | 200075_s_at |
| U50532.1 | CG005 | hypothetical protein from BCRA2 region | down | 214753_at |
| BC006547.2 | EEF2 | eukaryotic translation elongation factor 2 | down | 204102_s_at |
| BC008797.2 | FVT1 | follicular lymphoma variant translocation 1 | down | 202419_at |
| BC000807.1 | ZNF160 | zinc finger protein 160 | down | 214715_x_at |
| AL080112.1 | — | — | down | 216859_x_at |
| BC033718.1 /// BC046176.1 /// BC038443.1 | C21orf106 | chromosome 21 open reading frame 106 | down | 215529_x_at |
| NM_000346.1 | SOX9 | SRY (sex determining region Y)-box 9 (campomelic dysplasia, autosomal sex-reversal) | up | 202936_s_at |
| BC008710.1 | SUI1 | putative translation initiation factor | up | 212130_x_at |
| Hs.288575 (UNIGENE ID) | — | *Homo sapiens* cDNA FLJ14090 fis, clone MAMMA1000264. | down | 215204_at |
| AF020591.1 | AF020591 | zinc finger protein | down | 218735_s_at |

TABLE 2-continued

84 Gene Group

| GenBank ID (unless otherwise mentioned) | Gene Name | Description | Direction in Cancer | Affymetrix ID |
|---|---|---|---|---|
| BC000423.2 | ATP6V0B | ATPase, H+ transporting, lysosomal 21 kDa, V0 subunit c" /// ATPase, H+ transporting, lysosomal 21 kDa, V0 subunit c" | up | 200078_s_at |
| BC002503.2 | SAT | spermidine/spermine N1-acetyltransferase | down | 203455_s_at |
| BC008710.1 | SUI1 | putative translation initiation factor | up | 212227_x_at |
| — | — | *Homo sapiens* transcribed sequences | down | 222282_at |
| BC009185.2 | DCLRE1C | DNA cross-link repair 1C (PSO2 homolog, *S. cerevisiae*) | down | 219678_x_at |
| Hs.528304 (UNIGENE ID) | ADAM28 | a disintegrin and metalloproteinase domain 28 | down | 208268_at |
| U50532.1 | CG005 | hypothetical protein from BCRA2 region | down | 221899_at |
| BC013923.2 | SOX2 | SRY (sex determining region Y)-box 2 | down | 213721_at |
| BC031091 | ODAG | ocular development-associated gene | down | 214718_at |
| NM_007062 | PWP1 | nuclear phosphoprotein similar to *S. cerevisiae* PWP1 | up | 201608_s_at |
| Hs.249591 (Unigene ID) | FLJ20686 | hypothetical protein FLJ20686 | down | 205684_s_at |
| BC075839.1 /// BC073760.1 | KRT8 | keratin 8 | up | 209008_x_at |
| BC072436.1 /// BC004560.2 | HYOU1 | hypoxia up-regulated 1 | up | 200825_s_at |
| BC001016.2 | NDUFA8 | NADH dehydrogenase (ubiquinone) 1 alpha subcomplex, 8, 19 kDa | up | 218160_at |
| Hs.286261 (Unigene ID) | FLJ20195 | hypothetical protein FLJ20195 | down | 57739_at |
| AF348514.1 | — | *Homo sapiens* fetal thymus prothymosin alpha mRNA, complete cds | down | 211921_x_at |
| BC005023.1 | CGI-128 | CGI-128 protein | up | 218074_at |
| BC066337.1 /// BC058736.1 /// BC050555.1 | KTN1 | kinectin 1 (kinesin receptor) | down | 200914_x_at |
| — | — | — | down | 216384_x_at |
| Hs.216623 (Unigene ID) | ATP8B1 | ATPase, Class I, type 8B, member 1 | down | 214594_x_at |
| BC072400.1 | THOC2 | THO complex 2 | down | 222122_s_at |
| BC041073.1 | PRKX | protein kinase, X-linked | down | 204060_s_at |
| U43965.1 | ANK3 | ankyrin 3, node of Ranvier (ankyrin G) | down | 215314_at |
| — | — | — | down | 208238_x_at |
| BC021258.2 | TRIM5 | tripartite motif-containing 5 | down | 210705_s_at |
| BC016057.1 | USH1C | Usher syndrome 1C (autosomal recessive, severe) | down | 211184_s_at |
| BC016713.1 /// BC014535.1 /// AF237771.1 | PARVA | parvin, alpha | down | 215418_at |
| BC000360.2 | EIF4EL3 | eukaryotic translation initiation factor 4E-like 3 | up | 209393_s_at |
| BC007455.2 | SH3GLB1 | SH3-domain GRB2-like endophilin B1 | up | 210101_x_at |
| BC000701.2 | KIAA0676 | KIAA0676 protein | down | 212052_s_at |
| BC010067.2 | CHC1 | chromosome condensation 1 | down | 215011_at |
| BC023528.2 /// BC047680.1 | C14orf87 | chromosome 14 open reading frame 87 | up | 221932_s_at |
| BC064957.1 | KIAA0102 | KIAA0102 gene product | up | 201239_s_at |
| Hs.156701 (Unigene ID) | — | *Homo sapiens* cDNA FLJ14253 fis, clone OVARC1001376. | down | 215553_x_at |
| BC030619.2 | KIAA0779 | KIAA0779 protein | down | 213351_s_at |
| BC008710.1 | SUI1 | putative translation initiation factor | up | 202021_x_at |
| U43965.1 | ANK3 | ankyrin 3, node of Ranvier (ankyrin G) | down | 209442_x_at |
| BC066329.1 | SDHC | succinate dehydrogenase complex, subunit C, integral membrane protein, 15 kDa | up | 210131_x_at |
| Hs.438867 (Unigene ID) | — | *Homo sapiens* transcribed sequence with weak similarity to protein ref: NP_060312.1 (*H. sapiens*) hypothetical protein FLJ20489 [*Homo sapiens*] | down | 217713_x_at |
| BC035025.2 /// BC050330.1 | ALMS1 | Alstrom syndrome 1 | down | 214707_x_at |
| BC023976.2 | PDAP2 | PDGFA associated protein 2 | up | 203272_s_at |
| BC074852.2 /// BC074851.2 | PRKY | protein kinase, Y-linked | down | 206279_at |
| Hs.445885 (Unigene ID) | KIAA1217 | *Homo sapiens* cDNA FLJ12005 fis, clone HEMBB1001565. | down | 214912_at |
| BC008591.2 /// BC050440.1 /// BC048096.1 | KIAA0100 | KIAA0100 gene product | up | 201729_s_at |
| AF365931.1 | ZNF264 | zinc finger protein 264 | down | 205917_at |
| AF257099.1 | PTMA | prothymosin, alpha (gene sequence 28) | down | 200772_x_at |
| BC028912.1 | DNAJB9 | DnaJ (Hsp40) homolog, subfamily B, member 9 | up | 202842_s_at |

Table 3 shows one preferred 50 gene group that was identified as a group distinguishing smokers with cancer from smokers without cancer. The difference in expression is indicated at the column on the right as either "down", which indicates that the expression of that particular transcript was lower in smokers with cancer than in smokers without cancer, and "up", which indicates that the expression of that particular transcript was higher in smokers with cancer than smokers without cancer.

This gene group was identified using the GenePattern server from the Broad institute, which includes the Weighted Voting algorithm. The default settings, i.e., the signal to noise ratio and no gene filtering, were used, In one embodiment, the exemplary probes shown in the column "Asymetrix Id in the Human Genome U133 chip" can be used in the expression analysis.

TABLE 3

| 50 Gene Group | | | |
|---|---|---|---|
| GenBank ID | Gene Name | Direction in Cancer | Affymetrix Id in the Human Genome U133 chip |
| NM_007062.1 | PWP1 | up in cancer | 201608_s_at |
| NM_001281.1 | CKAP1 | up in cancer | 201804_x_at |
| BC000120.1 | | up in cancer | 202355_s_at |
| NM_014255.1 | TMEM4 | up in cancer | 202857_at |
| BC002642.1 | CTSS | up in cancer | 202901_x_at |
| NM_000346.1 | SOX9 | up in cancer | 202936_s_at |
| NM_006545.1 | NPR2L | up in cancer | 203246_s_at |
| BG034328 | | up in cancer | 203588_s_at |
| NM_021822.1 | APOBEC3G | up in cancer | 204205_at |
| NM_021069.1 | ARGBP2 | up in cancer | 204288_s_at |
| NM_019067.1 | FLJ10613 | up in cancer | 205010_at |
| NM_017925.1 | FLJ20686 | up in cancer | 205684_s_at |
| NM_017932.1 | FLJ20700 | up in cancer | 207730_x_at |
| NM_030757.1 | MKRN4 | up in cancer | 208082_x_at |
| NM_030972.1 | MGC5384 | up in cancer | 208137_x_at |
| AF126181.1 | BCG1 | up in cancer | 208682_s_at |
| U93240.1 | | up in cancer | 209653_at |
| U90552.1 | | up in cancer | 209770_at |
| AF151056.1 | | up in cancer | 210434_x_at |
| U85430.1 | NFATC3 | up in cancer | 210556_at |
| U51007.1 | | up in cancer | 211609_x_at |
| BC005969.1 | | up in cancer | 211759_x_at |

TABLE 3-continued

| 50 Gene Group | | | |
|---|---|---|---|
| GenBank ID | Gene Name | Direction in Cancer | Affymetrix Id in the Human Genome U133 chip |
| NM_002271.1 | | up in cancer | 211954_s_at |
| AL566172 | | up in cancer | 212041_at |
| AB014576.1 | KIAA0676 | up in cancer | 212052_s_at |
| BF218804 | AFURS1 | down in cancer | 212297_at |
| AK022494.1 | | down in cancer | 212932_at |
| AA114843 | | down in cancer | 213884_s_at |
| BE467941 | | down in cancer | 214153_at |
| NM_003541.1 | HIST1H4K | down in cancer | 214463_x_at |
| R83000 | BTF3 | down in cancer | 214800_x_at |
| AL161952.1 | GLUL | down in cancer | 215001_s_at |
| AK023843.1 | PGF | down in cancer | 215179_x_at |
| AK021571.1 | MUC20 | down in cancer | 215208_x_at |
| AK023783.1 | — | down in cancer | 215604_x_at |
| AU147182 | | down in cancer | 215620_at |
| AL080112.1 | — | down in cancer | 216859_x_at |
| AW971983 | | down in cancer | 217588_at |
| AI683552 | — | down in cancer | 217679_x_at |
| NM_024006.1 | IMAGE3455200 | down in cancer | 217949_s_at |
| AK026565.1 | FLJ10534 | down in cancer | 218155_x_at |
| NM_014182.1 | ORMDL2 | down in cancer | 218556_at |
| NM_021800.1 | DNAJC12 | down in cancer | 218976_at |
| NM_016049.1 | CGI-112 | down in cancer | 219203_at |
| NM_019023.1 | PRMT7 | down in cancer | 219408_at |
| NM_021971.1 | GMPPB | down in cancer | 219920_s_at |
| NM_014128.1 | — | down in cancer | 220856_x_at |
| AK025651.1 | | down in cancer | 221648_s_at |
| AA133341 | C14orf87 | down in cancer | 221932_s_at |
| AF198444.1 | | down in cancer | 222168_at |

Table 4 shows one preferred 36 gene group that was identified as a group distinguishing smokers with cancer from smokers without cancer. The difference in expression is indicated at the column on the right as either "down", which indicates that the expression of that particular transcript was lower in smokers with cancer than in smokers without cancer, and "up", which indicates that the expression of that particular transcript was higher in smokers with cancer than smokers without cancer.

In one embodiment the exemplary probes shown in the column "Affymetrix Id in the Human Genome U133 chip" can be used in the expression analysis.

TABLE 4

| 36 Gene Group | | | |
|---|---|---|---|
| GenBank ID | Gene Name | Gene Description | Affy ID |
| NM_007062.1 | PWP1 | nuclear phosphoprotein similar to S. cerevisiae PWP1 | 201608_s_at |
| NM_001281.1 | CKAP1 | cytoskeleton associated protein 1 | 201804_x_at |
| BC002642.1 | CTSS | cathepsin S | 202901_x_at |
| NM_000346.1 | SOX9 | SRY (sex determining region Y)-box 9 (campomelic dysplasia, autosomal sex-reversal) | 202936_s_at |
| NM_006545.1 | NPR2L | homologous to yeast nitrogen permease (candidate tumor suppressor) | 203246_s_at |
| BG034328 | | transcription factor Dp-2 (E2F dimerization partner 2) | 203588_s_at |
| NM_019067.1 | FLJ10613 | hypothetical protein FLJ10613 | 205010_at |
| NM_017925.1 | FLJ20686 | hypothetical protein FLJ20686 | 205684_s_at |
| NM_017932.1 | FLJ20700 | hypothetical protein FLJ20700 | 207730_x_at |
| NM_030757.1 | MKRN4 | makorin, ring finger protein, 4 /// makorin, ring finger protein, 4 | 208082_x_at |
| NM_030972.1 | MGC5384 | hypothetical protein MGC5384 | 208137_x_at |
| NM_002268 /// NM_032771 | KPNA4 | karyopherin alpha 4 (importin alpha 3) | 209653_at |
| NM_007048 /// NM_194441 | BTN3A1 | butyrophilin, subfamily 3, member A1 | 209770_at |
| NM_006694 | JBT | jumping translocation breakpoint | 210434_x_at |
| U85430.1 | NFATC3 | nuclear factor of activated T-cells, cytoplasmic, calcineurin-dependent 3 | 210556_at |
| NM_004691 | ATP6V0D1 | ATPase, H+ transporting, lysosomal 38 kDa, V0 subunit d isoform 1 | 212041_at |
| AB014576.1 | KIAA0676 | KIAA0676 protein | 212052_s_at |
| BF218804 | AFURS1 | ATPase family homolog up-regulated in senescence cells | 212297_at |
| BE467941 | | EVOVL family member 5, elongation of long chain fatty acids (FEN1/Elo2, SUR4/Elo3-like, yeast) | 214153_at |

TABLE 4-continued

36 Gene Group

| GenBank ID | Gene Name | Gene Description | Affy ID |
|---|---|---|---|
| R83000 | BTF3 | basic transcription factor 3 | 214800_x_at |
| AL161952.1 | GLUL | glutamate-ammonia ligase (glutamine synthase) | 215001_s_at |
| AK023843.1 | PGF | placental growth factor, vascular endothelial growth factor-related protein | 215179_x_at |
| AK021571.1 | MUC20 | mucin 20 | 215208_x_at |
| AK023783.1 | — | *Homo sapiens* cDNA FLJ13721 fis, clone PLACE2000450. | 215604_x_at |
| AD080112.1 | — | — | 216859_x_at |
| AW971983 | | cation, sperm associated 2 | 217588_at |
| AI683552 | — | — | 217679_x_at |
| NM_024006.1 | IMAGE3455200 | hypothetical protein IMAGE3455200 | 217949_s_at |
| AK026565.1 | FLJ10534 | hypothetical protein FLJ10534 | 218155_x_at |
| NM_014182.1 | ORMDL2 | ORM1-like 2 (*S. cerevisiae*) | 218556_at |
| NM_021800.1 | DNAJC12 | J Domain containing protein 1 | 218976_at |
| NM_016049.1 | CGI-112 | comparative gene identification transcript 112 | 219203_at |
| NM_021971.1 | GMPPB | GDP-mannose pyrophosphorylase B | 219920_s_at |
| NM_014128.1 | — | — | 220856_x_at |
| AA133341 | C14orf87 | chromosome 14 open reading frame 87 | 221932_s_at |
| AF198444.1 | | *Homo sapiens* 10q21 mRNA sequence | 222168_at |

In one embodiment, the gene group of the present invention comprises at least, for example, 5, 10, 15, 20, 25, 30, more preferably at least 36, still more preferably at least about 40, still more preferably at least about 50, still more preferably at least about 60, still more preferably at least about 70, still more preferably at least about 80, still more preferably at least about 86, still more preferably at least about 90, still more preferably at least about 96 of the genes as shown in Tables 1-4.

In one preferred embodiment, the gene group comprises 36-180 genes selected from the group consisting of the genes listed in Tables 1-4.

In one embodiment, the invention provides group of genes the expression of which is lower in individuals with cancer.

Accordingly, in one embodiment, the invention provides of a group of genes useful in diagnosing lung diseases, wherein the expression of the group of genes is lower in individuals exposed to air pollutants with cancer as compared to individuals exposed to the same air pollutant who do not have cancer, the group comprising probes that hybridize at least 5, preferably at least about 5-10, still more preferably at least about 10-20, still more preferably at least about 20-30, still more preferably at least about 30-40, still more preferably at least about 40-50, still more preferably at least about 50-60, still more preferably at least about 60-70, still more preferably about 72 genes consisting of transcripts (transcripts are identified using their GenBank ID or Unigene ID numbers and the corresponding gene names appear in Table 1): NM_003335; NM_001319; NM_021145.1; NM_001003698 /// NM_001003699 ///; NM_002955; NM_002853.1; NM_019067.1; NM_024917.1; NM_020979.1; NM_005597.1; NM_007031.1; NM_009590.1; NM_020217.1; NM_025026.1; NM_014709.1; NM_014896.1; AF010144; NM_005374.1; NM_006534 /// NM_181659; NM_014033; NM_016138; NM_007048 /// NM_194441; NM_000051 /// NM_138292 /// NM_138293; NM_000410 /// NM_139002 /// NM_139003 /// NM_139004 /// NM_139005 /// NM_139006 /// NM_139007 /// NM_139008 /// NM_139009 /// NM_139010 /// NM_139011; NM_012070 /// NM_139321 /// NM_139322; NM_006095; AI632181; AW024467; NM_021814; NM_005547.1; NM_203458; NM_015547 /// NM_147161; AB007958.1; NM_207488; NM_005809 /// NM_181737 /// NM_81738; NM_016248 /// NM_144490; AK022213.1; NM_005708; NM_207102; AK023895; NM_144606 /// NM_144997; NM_018530; AK021474; U43604.1; AU147017; AF222691.1; NM_015116; NM_01005375 /// NM_001005785 /// NM_001005786 /// NM_004081 /// NM_020363 /// NM_020364 /// NM_020420; AC004692; NM_001014; NM_000585 /// NM_172174 /// NM_172175; NM_054020 /// NM_172095 /// NM_172096 /// NM_172097; BE466926; NM_018011; NM_024077; NM_019011 /// NM_207111 /// NM_207116; NM_017646; NM_014395; NM_014336; NM_018097; NM_019014; NM_024804; NM_018260; NM_018118; NM_014128; NM_024084; NM_005294; AF077053; NM_000693; NM_033128; NM_020706; AI523613; and NM_014884.

In another embodiment, the invention provides of a group of genes useful in diagnosing lung diseases wherein the expression of the group of genes is lower in individuals exposed to air pollutants with cancer as compared to individuals exposed to the same air pollutant who do not have cancer, the group comprising probes that hybridize at least 5, preferably at least about 5-10, still more preferably at least about 10-20, still more preferably at least about 20-30, still more preferably at least about 30-40, still more preferably at least about 40-50, still more preferably at least about 50-60, still more preferably about 63 genes consisting of transcripts (transcripts are identified using their GenBank ID or Unigene ID numbers and the corresponding gene names appear in Table 2): NM_030757.1; R83000; AK021571.1; NM_17932.1; U85430.1; AI683552; BC002642.1; AW024467; NM_030972.1; BC021135.1; AL161952.1; AK026565.1; AK023783.1; BF218804; AK023843.1; BC001602.1; BC034707.1; BC064619.1; AY280502.1; BC059387.1; BC061522.1; U50532.1; BC006547.2; BC008797.2; BC000807.1; AL080112.1; BC033718.1 /// BC046176.1///; BC038443.1; Hs.288575 (UNIGENE ID); AF020591.1; BC002503.2; BC009185.2; Hs.528304 (UNIGENE ID); U50532.1; BC013923.2; BC031091; Hs.249591 (Unigene ID); Hs.286261 (Unigene ID); AF348514.1; BC066337.1 /// BC058736.1 /// BC050555.1; Hs.216623 (Unigene ID); BC072400.1; BC041073.1; U43965.1; BC021258.2; BC016057.1; BC016713.1 /// BC014535.1 /// AF237771.1; BC000701.2; BC010067.2; Hs.156701 (Unigene ID); BC030619.2; U43965.1; Hs.438867 (Unigene ID); BC035025.2 ///BC050330.1; BC074852.2/// BC074851.2; Hs.445885 (Unigene ID); AF365931.1; and AF257099.1

In another embodiment, the invention provides of a group of genes useful in diagnosing lung diseases wherein the expression of the group of genes is lower in individuals exposed to air pollutants with cancer as compared to individuals exposed to the same air pollutant who do not have cancer, the group comprising probes that hybridize at least 5, preferably at least about 5-10, still more preferably at least about 10-20, still more preferably at least about 20-25, still more preferably about 25 genes consisting of transcripts (transcripts are identified using their GenBank ID or Unigene ID numbers and the corresponding gene names appear in Table 3): BF218804; AK022494.1; AA114843; BE467941; NM_003541.1; R83000; AL161952.1; AK023843.1; AK021571.1; AK023783.1; AU147182; AL080112.1; AW971983; AI683552; NM_024006.1; AK026565.1; N_014182.1; NM_021800.1; NM_016049.1; NM_019023.1; NM_021971.1; NM_014128.1; AK025651.1; AA133341; and AF198444.1.

In another embodiment, the invention provides of a group of genes useful in diagnosing lung diseases wherein the expression of the group of genes is higher in individuals exposed to air pollutants with cancer as compared to individuals exposed to the same air pollutant who do not have cancer, the group comprising probes that hybridize at least to 5, preferably at least about 5-10, still more preferably at least about 10-20, still more preferably at least about 20-25, still more preferably about 25 genes consisting of transcripts (transcripts are identified using their GenBank ID or Unigene ID numbers and the corresponding gene names appear in Table 1): NM_000918; NM_006430.1; NM_001416.1; NM_004090; NM_006406.1; NM_003001.2; NM_006545.1; NM_002437.1; NM_006286; NM_001123 /// NM_006721; NM_024824; NM_004935.1; NM_001696; NM_005494 /// NM_058246; NM_006368; NM_002268 /// NM_032771; NM_006694; NM_004691; NM_012394; NM_021800; NM_016049; NM_138387; NM_024531; and NM_018509.

In another embodiment, the invention provides of a group of genes useful in diagnosing lung diseases wherein the expression of the group of genes is higher in individuals exposed to air pollutants with cancer as compared to individuals exposed to the same air pollutant who do not have cancer, the group comprising probes that hybridize at least to 5, preferably at least about 5-10, still more preferably at least about 10-20, still more preferably at least about 20-23, still more preferably about 23 genes consisting of transcripts (transcripts are identified using their GenBank ID or Unigene ID numbers and the corresponding gene names appear in Table 2): NM_014182.1; NM_001281.1; NM_024006.1; AF135421.1; L76200.1; NM_000346.1; BC008710.1; BC000423.2; BC008710.1; NM_007062; BC075839.1 /// BC073760.1; BC072436.1 /// BC004560.2; BC001016.2; BC005023.1; BC000360.2; BC007455.2; BC023528.2 /// BC047680.1; BC064957.1; BC008710.1; BC066329.1; BC023976.2; BC008591.2 /// BC050440.1 /// BC048096.1; and BC028912.1.

In another embodiment, the invention provides of a group of genes useful in diagnosing lung diseases wherein the expression of the group of genes is higher in individuals exposed to air pollutants with cancer as compared to individuals exposed to the same air pollutant who do not have cancer, the group comprising probes that hybridize at least about 5-10, still more preferably at least about 10-20, still more preferably at least about 20-25, still their GenBank ID or Unigene ID numbers and the corresponding gene names appear in Table 3): NM_007062.1; NM_001281.1; BC000120.1; NM_014255.1; BC002642.1; NM_000346.1; NM_006545.1; BG034328; NM_021822.1; NM_021069.1; NM_019067.1; NM_017925.1; NM_017932.1; NM_030757.1; NM_030972.1; AF126181.1; U93240.1; U90552.1; AF151056.1; U85430.1; U51007.1; BC005969.1; NM_002271.1; AL566172; and AB014576.1.

In one embodiment, the invention provides a method of diagnosing lung disease comprising the steps of measuring the expression profile of a gene group in an individual suspected of being affected or being at high risk of a lung disease (i.e. test individual), and comparing the expression profile (i.e. control profile) to an expression profile of an individual without the lung disease who has also been exposed to similar air pollutant than the test individual (i.e. control individual), wherein differences in the expression of genes when compared between the afore mentioned test individual and control individual of at least 10, more preferably at least 20, still more preferably at least 30, still more preferably at least 36, still more preferably between 36-180, still more preferably between 36-96, still more preferably between 36-84, still more preferably between 36-50, is indicative of the test individual being affected with a lung disease. Groups of about 36 genes as shown in table 4, about 50 genes as shown in table 3, about 84 genes as shown in table 2 and about 96 genes as shown in table 1 are preferred. The different gene groups can also be combined, so that the test individual can be screened for all, three, two, or just one group as shown in tables 1-4.

Figure 10A:
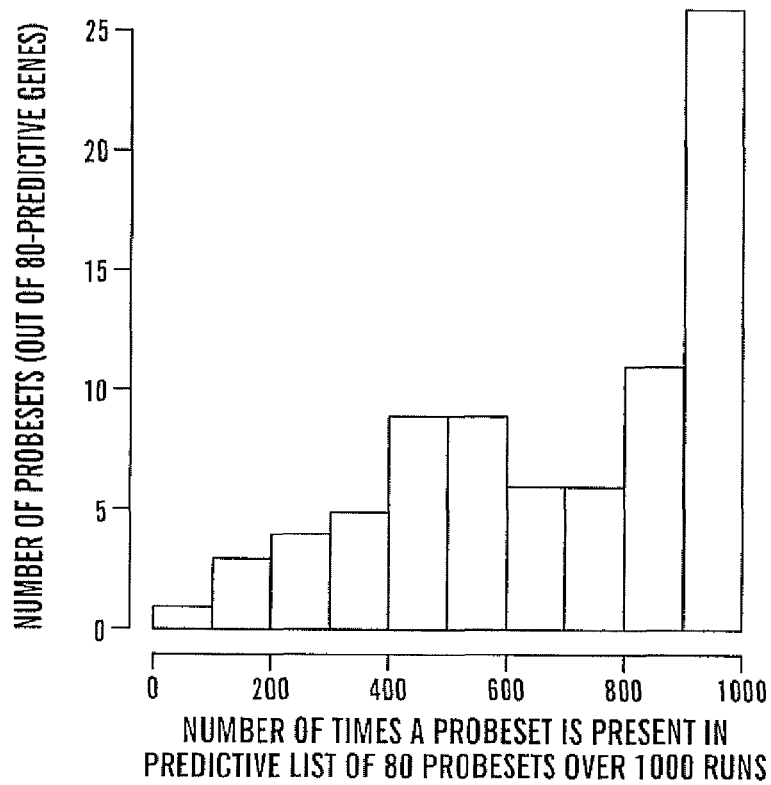
FIG. 10A shows the number of times each of the 80-predictive probe sets from the actual biomarker was present in the predictive lists of 80 probe sets derived from 1000 runs of the algorithm.
Figure 10B:
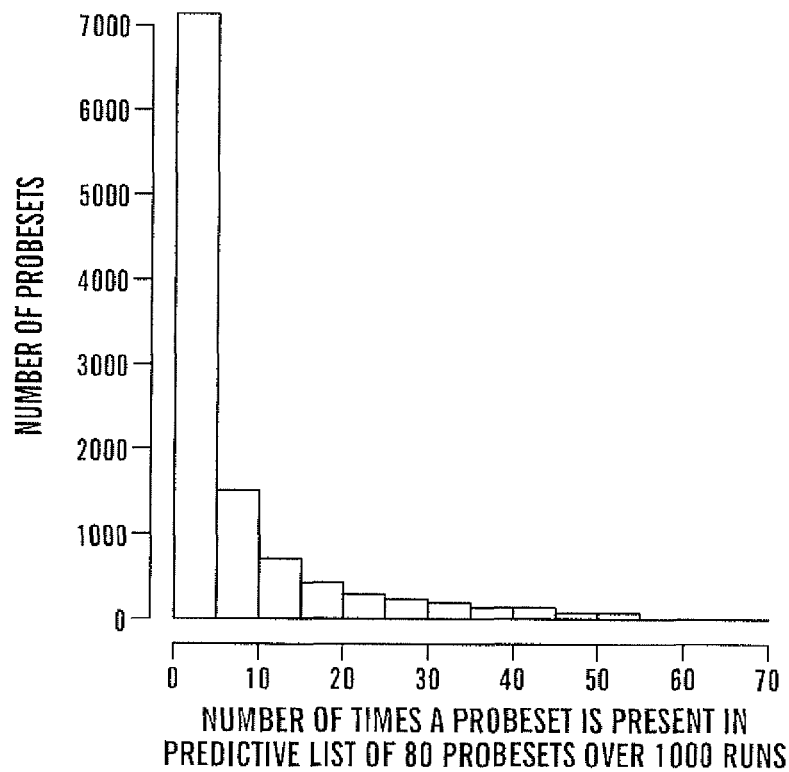
FIG. 10B shows the Number of times a probe set was present in the predictive lists of 80 probe sets derived from 1000 random runs of the algorithm described in Supplemental Table 7.

For example, if the expression profile of a test individual exposed to cigarette smoke is compared to the expression profile of the 50 genes shown in table 3, using the Affymetrix inc probe set on a gene chip as shown in table 3, the expression profile that is similar to the one shown in FIG. 10 for the individuals with cancer, is indicative that the test individual has cancer. Alternatively, if the expression profile is more like the expression profile of the individuals who do not have cancer in FIG. 10, the test individual likely is not affected with lung cancer.

The group of 50 genes was identified using the GenePattern server from the Broad Institute, which includes the Weighted Voting algorithm. The default settings, i.e., the signal to noise ratio and no gene filtering, were used. GenePattern is available through the World Wide Web at location broad.mit.edu/cancer/software/genepattern. This program allows analysis of data in groups rather than as individual genes. Thus, in one preferred embodiment, the expression of substantially all 50 genes of Table 3, are analyzed together. The expression profile of lower that normal expression of genes selected from the group consisting of BF218804; AK022494.1; AA114843; BE467941; NM_003541.1; R83000; AL161952.1; AK023843.1; AK021571.1; AK023783.1; AU147182; AL080112.1; AW971983; AI683552; NM_024006.1; AK026565.1; NM_014182.1; NM_021800.1; NM_016049.1; NM_019023.1; NM_021971.1; NM_014128.1; AK025651.1; AA133341; and AF198444.2, and the gene expression profile of higher than normal expression of genes selected from the group consisting of NM_007062.1; NM_001281.1; BC000120.1; NM_014255.1; BC002642.1; NM_000346.1; NM_006545.1; BG034328; NM_21822.1; NM_021069.1; NM_019067.1; NM_017925.1; NM_017932.1; NM_030757.1; NM_030972.1; AF126181.1; U93240.1; U90552.1; AF151456.1; U85430.1; U51007.1; BC005969.1; NM_002271.1; AL566172; and AB014576.1, is indicative of the individual having or being at high risk of developing lung disease, such as lung cancer. In one preferred embodiment, the expression pattern of all the genes in the Table 3 is analyzed. In one embodiment, in addition to analyzing the group of predictor genes of Table 3, 1, 2, 3, 4, 5, 6, 7, 8, 9, 10-15, 15-20, 20-30, or more of the individual predictor genes identified using the t-test analysis are analyzed. Any combination of, for example, 5-10 or more of the group predictor genes and 5-10, or more of the individual genes can also be used.

The term "expression profile" as used herein, refers to the amount of the gene product of each of the analyzed individual genes in the sample. The "expression profile" is like a signature expression map, like the one shown for each individual in FIG. 10, on the Y-axis.

The term "lung disease", as used herein, refers to disorders including, but not limited to, asthma, chronic bronchitis, emphysema, bronchietasis, primary pulmonary hypertension and acute respiratory distress syndrome. The methods described herein may also be used to diagnose or treat lung disorders that involve the immune system including, hypersensitivity pneumonitis, eosinophilic pneumonias, and persistent fungal infections, pulmonary fibrosis, systemic sclerosis, idiopathic pulmonary hemosiderosis, pulmonary alveolar proteinosis, cancers of the lung such as adenocarcinoma, squamous cell carcinoma, small cell and large cell carcinomas, and benign neoplasm of the lung including bronchial adenomas and hamartomas. In one preferred embodiment, the lung disease is lung cancer.

The biological samples useful according to the present invention include, but are not limited to tissue samples, cell samples, and excretion samples, such as sputum or saliva, of the airways. The samples useful for the analysis methods according to the present invention can be taken from the mouth, the bronchial airways, and the lungs.

The term "air pollutants", as used herein, refers to any air impurities or environmental airway stress inducing agents, such as cigarette smoke, cigar smoke, smog, asbestos, and other air pollutants that have suspected or proven association to lung diseases.

The term "individual", as used herein, preferably refers to human. However, the methods are not limited to humans, and a skilled artisan can use the diagnostic/prognostic gene groupings of the present invention in, for example, laboratory test animals, preferably animals that have lungs, such as non-human primates, murine species, including, but not limited to rats and mice, dogs, sheep, pig, guinea pigs, and other model animals.

The phrase "altered expression" as used herein, refers to either increased or decreased expression in an individual exposed to air pollutant, such as a smoker, with cancer when compared to an expression pattern of the lung cells from an individual exposed to similar air pollutant, such as smoker, who does not have cancer. Tables 1 and 2 show the preferred expression pattern changes of the invention. The terms "up" and "down" in the tables refer to the amount of expression in a smoker with cancer to the amount of expression in a smoker without cancer. Similar expression pattern changes are likely associated with development of cancer in individuals who have been exposed to other airway pollutants.

In one embodiment, the group of genes the expression of which is analyzed in diagnosis and/or prognosis of lung cancer are selected from the group of 80 genes as shown in Table 5. Any combination of genes can be selected from the 80 genes. In one embodiment, the combination of 20 genes shown in Table 7 is selected. In one embodiment, a combination of genes from Table 6 is selected.

TABLE 5

Group of 80 genes or prognostic and diagnostic testing of lung cancer.

| Affymetrix probe ID No. that can be used to identify the gene/nucleic acid sequence in the next column | Gene symbol | Number of runs the gene is indicated in cancer samples as differentially expressed out of 1000 test runs | Signal to noise in a cancer sample. Negative values indicate increase of expression in lung cancer, positive values indicate decrease of expression in lung cancer. |
|---|---|---|---|
| 200729_s_at | ACTR2 | 736 | −0.22284 |
| 200760_s_at | ARL6IP5 | 483 | −0.21221 |
| 201399_s_at | TRAM1 | 611 | −0.21328 |
| 201444_s_at | ATP6AP2 | 527 | −0.21487 |
| 201635_s_at | FXR1 | 458 | −0.2162 |
| 201689_s_at | TPD52 | 565 | −0.22292 |
| 201925_s_at | DAF | 717 | −0.25875 |
| 201926_s_at | DAF | 591 | −0.23228 |
| 201946_s_at | CCT2 | 954 | −0.24592 |
| 202118_s_at | CPNE3 | 334 | −0.21273 |
| 202704_at | TOB1 | 943 | −0.25724 |
| 202833_s_at | SERPINA1 | 576 | −0.20583 |
| 202935_s_at | SOX9 | 750 | −0.25574 |
| 203413_at | NELL2 | 629 | −0.23576 |
| 203881_s_at | DMD | 850 | −0.24341 |
| 203908_at | SLC4A4 | 887 | −0.23167 |
| 204006_s_at | FCGR3A /// FCGR3B | 207 | −0.20071 |
| 204403_x_at | KIAA0738 | 923 | 0.167772 |
| 204427_s_at | RNP24 | 725 | −0.2366 |
| 206056_x_at | SPN | 976 | 0.196398 |
| 206169_x_at | RoXaN | 984 | 0.259637 |
| 207730_x_at | HDGF2 | 969 | 0.169108 |
| 207756_at | — | 855 | 0.161708 |
| 207791_s_at | RAB1A | 823 | −0.21704 |
| 207953_at | AD7C-NTP | 1000 | 0.218433 |
| 208137_x_at | — | 996 | 0.191938 |
| 208246_x_at | TK2 | 982 | 0.179058 |
| 208654_s_at | CD164 | 388 | −0.21228 |
| 208892_s_at | DUSP6 | 878 | −0.25023 |
| 209189_at | FOS | 935 | −0.27446 |

TABLE 5-continued

Group of 80 genes or prognostic and diagnostic testing of lung cancer.

| Affymetrix probe ID No. that can be used to identify the gene/nucleic acid sequence in the next column | Gene symbol | Number of runs the gene is indicated in cancer samples as differentially expressed out of 1000 test runs | Signal to noise in a cancer sample. Negative values indicate increase of expression in lung cancer, positive values indicate decrease of expression in lung cancer. |
|---|---|---|---|
| 209204_at | LMO4 | 78 | 0.158674 |
| 209267_s_at | SLC39A8 | 228 | −0.24231 |
| 209369_at | ANXA3 | 384 | −0.19972 |
| 209656_s_at | TMEM47 | 456 | −0.23033 |
| 209774_x_at | CXCL2 | 404 | −0.2117 |
| 210145_at | PLA2G4A | 475 | −0.26146 |
| 210168_at | C6 | 458 | −0.24157 |
| 210317_s_at | YWHAE | 803 | −0.29542 |
| 210397_at | DEFB1 | 176 | −0.22512 |
| 210679_x_at | — | 970 | 0.181718 |
| 211506_s_at | IL8 | 270 | −0.3105 |
| 212006_at | UBXD2 | 802 | −0.22094 |
| 213089_at | LOC153561 | 649 | 0.164097 |
| 213736_at | COX5B | 505 | 0.155243 |
| 213813_x_at | — | 789 | 0.178643 |
| 214007_s_at | PTK9 | 480 | −0.21285 |
| 214146_s_at | PPBP | 593 | −0.24265 |
| 214594_x_at | ATP8B1 | 962 | 0.284039 |
| 214707_x_at | ALMS1 | 750 | 0.164047 |
| 214715_x_at | ZNF160 | 996 | 0.198532 |
| 215204_at | SENP6 | 211 | 0.169986 |
| 215208_x_at | RPL35A | 999 | 0.228485 |
| 215385_at | FTO | 164 | 0.187634 |
| 215600_x_at | FBXW12 | 960 | 0.17329 |
| 215604_x_at | UBE2D2 | 998 | 0.224878 |
| 215609_at | STARD7 | 940 | 0.191953 |
| 215628_x_at | PPP2CA | 829 | 0.16391 |
| 215800_at | DUOX1 | 412 | 0.160036 |
| 215907_at | BACH2 | 987 | 0.178338 |
| 215978_x_at | LOC152719 | 645 | 0.163399 |
| 216834_at | — | 633 | −0.25508 |
| 216858_x_at | — | 997 | 0.232969 |
| 217446_x_at | — | 942 | 0.182612 |
| 217653_x_at | — | 976 | 0.270552 |
| 217679_x_at | — | 987 | 0.265918 |
| 217715_x_at | ZNF354A | 995 | 0.223881 |
| 217826_s_at | UBE2J1 | 812 | −0.23003 |
| 218155_x_at | FLJ10534 | 998 | 0.186425 |
| 218976_at | DNAJC12 | 486 | −0.22866 |
| 219392_x_at | FLJ11029 | 867 | 0.169113 |
| 219678_x_at | DCLRE1C | 877 | 0.169975 |
| 220199_s_at | FLJ12806 | 378 | −0.20713 |
| 220389_at | FLJ23514 | 102 | 0.239341 |
| 220720_x_at | FLJ14346 | 989 | 0.17976 |
| 221191_at | DKFZP434A0131 | 616 | 0.185412 |
| 221310_at | FGF14 | 511 | −0.19965 |
| 221765_at | — | 319 | −0.25025 |
| 222027_at | NUCKS | 547 | 0.171954 |
| 222104_x_at | GTF2H3 | 981 | 0.185025 |
| 222358_x_at | — | 564 | 0.194048 |

TABLE 6

Group of 535 genes useful in prognosis or diagnosis of lung cancer.

| Affymetrix probe ID No. that can be used to identify the gene/nucleic acid sequence in the next column | Gene symbol | Number of runs the gene is indicated in cancer samples as differentially expressed out of 1000 test runs | Signal to noise in a cancer sample. Negative values indicate increase of expression in lung cancer, positive values indicate decrease of expression in lung cancer. |
|---|---|---|---|
| 200729_s_at | ACTR2 | 736 | −0.22284 |
| 200760_s_at | ARL6IP5 | 483 | −0.21221 |
| 201399_s_at | TRAM1 | 611 | −0.21328 |
| 201444_s_at | ATP6AP2 | 527 | −0.21487 |
| 201635_s_at | FXR1 | 458 | −0.2162 |
| 201689_s_at | TPD52 | 565 | −0.22292 |

TABLE 6-continued

Group of 535 genes useful in prognosis or diagnosis of lung cancer.

| Affymetrix probe ID No. that can be used to identify the gene/nucleic acid sequence in the next column | Gene symbol | Number of runs the gene is indicated in cancer samples as differentially expressed out of 1000 test runs | Signal to noise in a cancer sample. Negative values indicate increase of expression in lung cancer, positive values indicate decrease of expression in lung cancer. |
|---|---|---|---|
| 201925_s_at | DAF | 717 | −0.25875 |
| 201926_s_at | DAF | 591 | −0.23228 |
| 201946_s_at | CCT2 | 954 | −0.24592 |
| 202118_s_at | CPNE3 | 334 | −0.21273 |
| 202704_at | TOB1 | 943 | −0.25724 |
| 202833_s_at | SERPINA1 | 576 | −0.20583 |
| 202935_s_at | SOX9 | 750 | −0.25574 |
| 203413_at | NELL2 | 629 | −0.23576 |
| 203881_s_at | DMD | 850 | −0.24341 |
| 203908_at | SLC4A4 | 887 | −0.23167 |
| 204006_s_at | FCGR3A /// FCGR3B | 207 | −0.20071 |
| 204403_x_at | KIAA0738 | 923 | 0.167772 |
| 204427_s_at | RNP24 | 725 | −0.2366 |
| 206056_x_at | SPN | 976 | 0.196398 |
| 206169_x_at | RoXaN | 984 | 0.259637 |
| 207730_x_at | HDGF2 | 969 | 0.169108 |
| 207756_at | — | 855 | 0.161708 |
| 207791_s_at | RAB1A | 823 | −0.21704 |
| 207953_at | AD7C-NTP | 1000 | 0.218433 |
| 208137_x_at | — | 996 | 0.191938 |
| 208246_x_at | TK2 | 982 | 0.179058 |
| 208654_s_at | CD164 | 388 | −0.21228 |
| 208892_s_at | DUSP6 | 878 | −0.25023 |
| 209189_at | FOS | 935 | −0.27446 |
| 209204_at | LMO4 | 78 | 0.158674 |
| 209267_s_at | SLC39A8 | 228 | −0.24231 |
| 209369_at | ANXA3 | 384 | −0.19972 |
| 209656_s_at | TMEM47 | 456 | −0.23033 |
| 209774_x_at | CXCL2 | 404 | −0.2117 |
| 210145_at | PLA2G4A | 475 | −0.26146 |
| 210168_at | C6 | 458 | −0.24157 |
| 210317_at | YWHAE | 803 | −0.29542 |
| 210397_at | DEFB1 | 176 | −0.22512 |
| 210679_x_at | — | 970 | 0.181718 |
| 211506_s_at | IL8 | 270 | −0.3105 |
| 212006_at | UBXD2 | 802 | −0.22094 |
| 213089_at | LOC153561 | 649 | 0.164097 |
| 213736_at | COX5B | 505 | 0.155243 |
| 213813_x_at | — | 789 | 0.178643 |
| 214007_s_at | PTK9 | 480 | −0.21285 |
| 214146_s_at | PPBP | 593 | −0.24265 |
| 214594_x_at | ATP8B1 | 962 | 0.284039 |
| 214707_x_at | ALMS1 | 750 | 0.164047 |
| 214715_x_at | ZNF160 | 996 | 0.198532 |
| 215204_at | SENP6 | 211 | 0.169986 |
| 215208_x_at | RPL35A | 999 | 0.228485 |
| 215385_at | FTO | 164 | 0.187634 |
| 215600_x_at | FBXW12 | 960 | 0.17329 |
| 215604_x_at | UBE2D2 | 998 | 0.224878 |
| 215609_at | STARD7 | 940 | 0.191953 |
| 215628_x_at | PPP2CA | 829 | 0.16391 |
| 215800_at | DUOX1 | 412 | 0.160036 |
| 215907_at | BACH2 | 987 | 0.178338 |
| 215978_x_at | LOC152719 | 645 | 0.163399 |
| 216834_at | — | 633 | −0.25508 |
| 216858_x_at | — | 997 | 0.232969 |
| 217446_x_at | — | 942 | 0.182612 |
| 217653_x_at | — | 976 | 0.270552 |
| 217679_x_at | — | 987 | 0.265918 |
| 217715_x_at | ZNF354A | 995 | 0.223881 |
| 217826_s_at | UBE2J1 | 812 | −0.23003 |
| 218155_x_at | FLJ10534 | 998 | 0.186425 |
| 218976_at | DNAJC12 | 486 | −0.22866 |
| 219392_x_at | FLJ11029 | 867 | 0.169113 |
| 219678_x_at | DCLRE1C | 877 | 0.169975 |
| 220199_s_at | FLJ12806 | 378 | −0.20713 |
| 220389_at | FLJ23514 | 102 | 0.239341 |
| 220720_x_at | FLJ14346 | 989 | 0.17976 |
| 221191_at | DKFZP434A0131 | 616 | 0.185412 |
| 221310_at | FGF14 | 511 | −0.19965 |
| 221765_at | — | 319 | −0.25025 |

TABLE 6-continued

Group of 535 genes useful in prognosis or diagnosis of lung cancer.

| Affymetrix probe ID No. that can be used to identify the gene/nucleic acid sequence in the next column | Gene symbol | Number of runs the gene is indicated in cancer samples as differentially expressed out of 1000 test runs | Signal to noise in a cancer sample. Negative values indicate increase of expression in lung cancer, positive values indicate decrease of expression in lung cancer. |
| --- | --- | --- | --- |
| 222027_at | NUCKS | 547 | 0.171954 |
| 222104_x_at | GTF2H3 | 981 | 0.186025 |
| 222358_x_at | — | 564 | 0.194048 |
| 202113_s_at | SNX2 | 841 | −0.20503 |
| 207133_x_at | ALPK1 | 781 | 0.155812 |
| 218989_x_at | SLC30A5 | 765 | −0.198 |
| 200751_s_at | HNRPC | 759 | −0.19243 |
| 220796_x_at | SLC35E1 | 691 | 0.158199 |
| 209362_at | SURB7 | 690 | −0.18777 |
| 216248_s_at | NR4A2 | 678 | −0.19796 |
| 203138_at | HAT1 | 669 | −0.18115 |
| 221428_s_at | TBL1XR1 | 665 | −0.19331 |
| 218172_s_at | DERL1 | 665 | −0.16341 |
| 215861_at | FLJ14031 | 651 | 0.156927 |
| 209288_s_at | CDC42EP3 | 638 | −0.20146 |
| 214001_x_at | RPS10 | 634 | 0.151006 |
| 209116_x_at | HBB | 626 | −0.12237 |
| 215595_x_at | GCNT2 | 625 | 0.136319 |
| 208891_at | DUSP6 | 617 | −0.17282 |
| 215067_x_at | PRDX2 | 616 | 0.160582 |
| 202918_s_at | PREI3 | 614 | −0.17003 |
| 211985_s_at | CALM1 | 614 | −0.20103 |
| 212019_at | RSL1D1 | 601 | 0.152717 |
| 216187_x_at | KNS2 | 591 | 0.14297 |
| 215066_at | PTPRF | 587 | 0.143323 |
| 212192_at | KCTD12 | 581 | −0.17535 |
| 217586_x_at | — | 577 | 0.147487 |
| 203582_s_at | RAB4A | 567 | −0.18289 |
| 220113_x_at | POLR1B | 563 | 0.15764 |
| 217232_x_at | HBB | 561 | −0.11398 |
| 201041_s_at | DUSP1 | 560 | −0.18661 |
| 211450_s_at | MSH6 | 544 | −0.15597 |
| 202648_at | RPS19 | 533 | 0.150087 |
| 202936_s_at | SOX9 | 533 | −0.17714 |
| 204426_at | RNP24 | 526 | −0.18959 |
| 206392_s_at | RARRES1 | 517 | −0.18328 |
| 208750_s_at | ARF1 | 515 | −0.19797 |
| 202089_s_at | SLC39A6 | 512 | −0.19904 |
| 211297_s_at | CDK7 | 510 | −0.15992 |
| 215373_x_at | FLJ12151 | 509 | 0.146742 |
| 213679_at | FLJ13946 | 492 | −0.10963 |
| 201694_s_at | EGR1 | 490 | −0.19478 |
| 209142_s_at | UBE2G1 | 487 | −0.18055 |
| 217706_at | LOC220074 | 483 | 0.11787 |
| 212991_at | FBXO9 | 476 | 0.148288 |
| 201289_at | CYR61 | 465 | −0.19925 |
| 206548_at | FLJ23556 | 465 | 0.141583 |
| 202593_s_at | MIR16 | 462 | −0.17042 |
| 202932_at | YES1 | 461 | −0.17637 |
| 220575_at | FLJ11800 | 461 | 0.116435 |
| 217713_x_at | DKFZP566N034 | 452 | 0.145994 |
| 211953_s_at | RANBP5 | 447 | −0.17838 |
| 203827_at | WIPI49 | 447 | −0.17767 |
| 221997_s_at | MRPL52 | 444 | 0.132649 |
| 217662_x_at | BCAP29 | 434 | 0.116886 |
| 218519_at | SLC35A5 | 428 | −0.15495 |
| 214833_at | KIAA0792 | 428 | 0.132943 |
| 201339_s_at | SCP2 | 426 | −0.18605 |
| 203799_at | CD302 | 422 | −0.16798 |
| 211090_s_at | PRPF4B | 421 | −0.1838 |
| 220071_x_at | C15orf25 | 420 | 0.138308 |
| 203946_s_at | ARG2 | 415 | −0.14964 |
| 213544_at | ING1L | 415 | 0.137052 |
| 209908_s_at | — | 414 | 0.131346 |
| 201688_s_at | TPD52 | 410 | −0.18965 |
| 215587_x_at | BTBD14B | 410 | 0.139952 |
| 201699_at | PSMC6 | 409 | −0.13784 |
| 214902_x_at | FLJ42393 | 409 | 0.140198 |
| 214041_x_at | RPL37A | 402 | 0.106746 |
| 203987_at | FZD6 | 392 | −0.19252 |
| 211696_x_at | HBB | 392 | −0.09508 |

TABLE 6-continued

Group of 535 genes useful in prognosis or diagnosis of lung cancer.

| Affymetrix probe ID No. that can be used to identify the gene/nucleic acid sequence in the next column | Gene symbol | Number of runs the gene is indicated in cancer samples as differentially expressed out of 1000 test runs | Signal to noise in a cancer sample. Negative values indicate increase of expression in lung cancer, positive values indicate decrease of expression in lung cancer. |
|---|---|---|---|
| 218025_s_at | PECI | 389 | −0.18002 |
| 215852_x_at | KIAA0889 | 382 | 0.12243 |
| 209458_x_at | HBA1 /// HBA2 | 380 | −0.09796 |
| 219410_at | TMEM45A | 379 | −0.22387 |
| 215375_x_at | — | 379 | 0.148377 |
| 206302_s_at | NUDT4 | 376 | −0.18873 |
| 208783_s_at | MCP | 372 | −0.15076 |
| 211374_x_at | — | 364 | 0.131101 |
| 220352_x_at | MGC4278 | 364 | 0.152722 |
| 216609_at | TXN | 363 | 0.15162 |
| 201942_s_at | CPD | 363 | −0.1889 |
| 202672_s_at | ATF3 | 361 | −0.12935 |
| 204959_at | MNDA | 359 | −0.21676 |
| 211996_s_at | KIAA0220 | 358 | 0.144358 |
| 222035_s_at | PAPOLA | 353 | −0.14487 |
| 208808_s_at | HMGB2 | 349 | −0.15222 |
| 203711_s_at | HIBCH | 347 | −0.13214 |
| 215179_x_at | PGF | 347 | 0.146279 |
| 213562_s_at | SQLE | 345 | −0.14669 |
| 203765_at | GCA | 340 | −0.1798 |
| 214414_x_at | HBA2 | 336 | −0.08492 |
| 217497_at | ECGF1 | 336 | 0.123255 |
| 220924_s_at | SLC38A2 | 333 | −0.17315 |
| 218139_s_at | C14orf108 | 332 | −0.15021 |
| 201096_s_at | ARF4 | 330 | −0.18887 |
| 220361_at | FLJ12476 | 325 | −0.15452 |
| 202169_s_at | AASDHPPT | 323 | −0.15787 |
| 202527_s_at | SMAD4 | 322 | −0.18399 |
| 202166_s_at | PPP1R2 | 320 | −0.16402 |
| 204634_at | NEK4 | 319 | −0.15511 |
| 215504_x_at | — | 319 | 0.145981 |
| 202388_at | RGS2 | 315 | −0.14894 |
| 215553_x_at | WDR45 | 315 | 0.137586 |
| 200598_s_at | TRA1 | 314 | −0.19349 |
| 202435_s_at | CYP1B1 | 313 | 0.056937 |
| 216206_x_at | MAP2K7 | 313 | 0.10383 |
| 212582_at | OSBPL8 | 313 | −0.17843 |
| 216509_x_at | MLLT10 | 312 | 0.123961 |
| 200908_s_at | RPLP2 | 308 | 0.136645 |
| 215108_x_at | TNRC9 | 306 | −0.1439 |
| 213872_at | C6orf62 | 302 | −0.19548 |
| 214395_x_at | EEF1D | 302 | 0.128234 |
| 222156_x_at | CCPG1 | 301 | −0.14725 |
| 201426_s_at | VIM | 301 | −0.17461 |
| 221972_s_at | Cab45 | 299 | −0.1511 |
| 219957_at | — | 298 | 0.130796 |
| 215123_at | — | 295 | 0.125434 |
| 212515_s_at | DDX3X | 295 | −0.14634 |
| 203357_s_at | CAPN7 | 295 | −0.17109 |
| 211711_s_at | PTEN | 295 | −0.12636 |
| 206165_s_at | CLCA2 | 293 | −0.17699 |
| 213959_s_at | KIAA1005 | 289 | −0.16592 |
| 215083_at | PSPC1 | 289 | 0.147348 |
| 219630_at | PDZK1IP1 | 287 | −0.15086 |
| 204018_x_at | HBA1 /// HBA2 | 286 | −0.08689 |
| 208671_at | TDE2 | 286 | −0.17839 |
| 203427_at | ASF1A | 286 | −0.14737 |
| 215281_x_at | POGZ | 286 | 0.142825 |
| 205749_at | CYP1A1 | 285 | 0.107118 |
| 212585_at | OSBPL8 | 282 | −0.13924 |
| 211745_x_at | HBA1 /// HBA2 | 281 | −0.08437 |
| 208078_s_at | SNF1LK | 278 | −0.14395 |
| 218041_x_at | SLC38A2 | 276 | −0.17003 |
| 212588_at | PTPRC | 270 | −0.1725 |
| 212397_at | RDX | 270 | −0.15613 |
| 208268_at | ADAM28 | 269 | 0.114996 |
| 207194_s_at | ICAM4 | 269 | 0.127304 |
| 222252_x_at | — | 269 | 0.132241 |
| 217414_x_at | HBA2 | 266 | −0.08974 |
| 207078_at | MED6 | 261 | 0.1232 |
| 215268_at | KIAA0754 | 261 | 0.13669 |

TABLE 6-continued

Group of 535 genes useful in prognosis or diagnosis of lung cancer.

| Affymetrix probe ID No. that can be used to identify the gene/nucleic acid sequence in the next column | Gene symbol | Number of runs the gene is indicated in cancer samples as differentially expressed out of 1000 test runs | Signal to noise in a cancer sample. Negative values indicate increase of expression in lung cancer, positive values indicate decrease of expression in lung cancer. |
|---|---|---|---|
| 221387_at | GPR147 | 261 | 0.128737 |
| 201337_s_at | VAMP3 | 259 | −0.17284 |
| 220218_at | C9orf68 | 259 | 0.125851 |
| 222356_at | TBL1Y | 259 | 0.126765 |
| 208579_x_at | H2BFS | 258 | −0.16608 |
| 219161_s_at | CKLF | 257 | −0.12288 |
| 202917_s_at | S100A8 | 256 | −0.19869 |
| 204455_at | DST | 255 | −0.13072 |
| 211672_s_at | ARPC4 | 254 | −0.17791 |
| 201132_at | HNRPH2 | 254 | −0.12817 |
| 218313_s_at | GALNT7 | 253 | −0.179 |
| 218930_s_at | FLJ11273 | 251 | −0.15878 |
| 219166_at | C14orf104 | 250 | −0.14237 |
| 212805_at | KIAA0367 | 248 | −0.16649 |
| 201551_s_at | LAMP1 | 247 | −0.18035 |
| 202599_s_at | NRIP1 | 247 | −0.16226 |
| 203403_s_at | RNF6 | 247 | −0.14976 |
| 214261_s_at | ADH6 | 242 | −0.1414 |
| 202033_s_at | RB1CC1 | 240 | −0.18105 |
| 203896_s_at | PLCB4 | 237 | −0.20318 |
| 209703_x_at | DKFZP586A0522 | 234 | 0.140153 |
| 211699_x_at | HBA1 /// HBA2 | 232 | −0.08369 |
| 210764_s_at | CYR61 | 231 | −0.13139 |
| 206391_at | RARRES1 | 230 | −0.16931 |
| 201312_s_at | SH3BGRL | 225 | −0.12265 |
| 200798_x_at | MCL1 | 221 | −0.13113 |
| 214912_at | — | 221 | 0.116262 |
| 204621_s_at | NR4A2 | 217 | −0.10896 |
| 217761_at | MTCBP-1 | 217 | −0.17558 |
| 205830_at | CLGN | 216 | −0.14737 |
| 218438_s_at | MED28 | 214 | −0.14649 |
| 207475_at | FABP2 | 214 | 0.097003 |
| 208621_s_at | VIL2 | 213 | −0.19678 |
| 202436_s_at | CYP1B1 | 212 | 0.042216 |
| 202539_s_at | HMGCR | 210 | −0.15429 |
| 210830_s_at | PON2 | 209 | −0.17184 |
| 211906_s_at | SERPINB4 | 207 | −0.14728 |
| 202241_at | TRIB1 | 207 | −0.10706 |
| 203594_at | RTCD1 | 207 | −0.13823 |
| 215863_at | TFR2 | 207 | 0.095157 |
| 221992_at | LOC283970 | 206 | 0.126744 |
| 221872_at | RARRES1 | 205 | −0.11496 |
| 219564_at | KCNJ16 | 205 | −0.13908 |
| 201329_s_at | ETS2 | 205 | −0.14994 |
| 214188_at | HIS1 | 203 | 0.1257 |
| 201667_at | GJA1 | 199 | −0.13848 |
| 201464_x_at | JUN | 199 | −0.09858 |
| 215409_at | LOC254531 | 197 | 0.094182 |
| 202583_s_at | RANBP9 | 197 | −0.13902 |
| 215594_at | — | 197 | 0.101007 |
| 214326_x_at | JUND | 196 | −0.1702 |
| 217140_s_at | VDAC1 | 196 | −0.14682 |
| 215599_at | SMA4 | 195 | 0.133438 |
| 209896_s_at | PTPN11 | 195 | −0.16258 |
| 204846_at | CP | 195 | −0.14378 |
| 222303_at | — | 193 | −0.10841 |
| 218218_at | DIP13B | 193 | −0.12136 |
| 211015_s_at | HSPA4 | 192 | −0.13489 |
| 208666_s_at | ST13 | 191 | −0.13361 |
| 203191_at | ABCB6 | 190 | 0.096808 |
| 202731_at | PDCD4 | 190 | −0.1545 |
| 209027_s_at | ABI1 | 190 | −0.15472 |
| 205979_at | SCGB2A1 | 189 | −0.15091 |
| 216351_x_at | DAZ1 /// DAZ3 /// DAZ2 /// DAZ4 | 189 | 0.106368 |
| 220240_s_at | C13orf11 | 188 | −0.16959 |
| 204482_at | CLDN5 | 187 | 0.094134 |
| 217234_s_at | VIL2 | 186 | −0.16035 |
| 214350_at | SNTB2 | 186 | 0.095723 |
| 201693_s_at | EGR1 | 184 | −0.10732 |
| 212328_at | KIAA1102 | 182 | −0.12113 |
| 220168_at | CASC1 | 181 | −0.1105 |

TABLE 6-continued

Group of 535 genes useful in prognosis or diagnosis of lung cancer.

| Affymetrix probe ID No. that can be used to identify the gene/nucleic acid sequence in the next column | Gene symbol | Number of runs the gene is indicated in cancer samples as differentially expressed out of 1000 test runs | Signal to noise in a cancer sample. Negative values indicate increase of expression in lung cancer, positive values indicate decrease of expression in lung cancer. |
|---|---|---|---|
| 203628_at | IGF1R | 180 | 0.067575 |
| 204622_x_at | NR4A2 | 180 | −0.11482 |
| 213246_at | C14orf109 | 180 | −0.16143 |
| 218728_s_at | HSPC163 | 180 | −0.13248 |
| 214753_at | PFAAP5 | 179 | 0.130184 |
| 206336_at | CXCL6 | 178 | −0.05634 |
| 201445_at | CNN3 | 178 | −0.12375 |
| 209886_s_at | SMAD6 | 176 | 0.079296 |
| 213376_at | ZBTB1 | 176 | −0.17777 |
| 213887_s_at | POLR2E | 175 | −0.16392 |
| 204783_at | MLF1 | 174 | −0.13409 |
| 218824_at | FLJ10781 | 173 | 0.1394 |
| 212417_at | SCAMP1 | 173 | −0.17052 |
| 202437_s_at | CYP1B1 | 171 | 0.033438 |
| 217528_at | CLCA2 | 169 | −0.14179 |
| 218170_at | ISOC1 | 169 | −0.14064 |
| 206278_at | PTAFR | 167 | 0.087096 |
| 201939_at | PLK2 | 167 | −0.11049 |
| 200907_s_at | KIAA0992 | 166 | −0.18323 |
| 207480_s_at | MEIS2 | 166 | −0.15232 |
| 201417_at | SOX4 | 162 | −0.09617 |
| 213826_s_at | — | 160 | 0.097313 |
| 214953_s_at | APP | 159 | −0.1645 |
| 204897_at | PTGER4 | 159 | −0.08152 |
| 201711_x_at | RANBP2 | 158 | −0.17192 |
| 202457_s_at | PPP3CA | 158 | −0.18821 |
| 206683_at | ZNF165 | 158 | −0.08848 |
| 214581_x_at | TNFRSF21 | 156 | −0.14624 |
| 203392_s_at | CTBP1 | 155 | −0.16161 |
| 212720_at | PAPOLA | 155 | −0.14809 |
| 207758_at | PPM1F | 155 | 0.090007 |
| 220995_at | STXBP6 | 155 | 0.106749 |
| 213831_at | HLA-DQA1 | 154 | 0.193368 |
| 212044_s_at | — | 153 | 0.098889 |
| 202434_s_at | CYP1B1 | 153 | 0.049744 |
| 206166_s_at | CLCA2 | 153 | −0.1343 |
| 218343_s_at | GTF3C3 | 153 | −0.13066 |
| 202557_at | STCH | 152 | −0.14894 |
| 201133_s_at | PJA2 | 152 | −0.18481 |
| 213605_s_at | MGC22265 | 151 | 0.130895 |
| 210947_s_at | MSH3 | 151 | −0.12595 |
| 208310_s_at | C7orf28A /// C7orf28B | 151 | −0.15523 |
| 209307_at | — | 150 | −0.1667 |
| 215387_x_at | GPC6 | 148 | 0.114691 |
| 213705_at | MAT2A | 147 | 0.104855 |
| 213979_s_at | — | 146 | 0.121562 |
| 212731_at | LOC157567 | 146 | −0.1214 |
| 210117_at | SPAG1 | 146 | −0.11236 |
| 200641_s_at | YWHAZ | 145 | −0.14071 |
| 210701_at | CFDP1 | 145 | 0.151664 |
| 217152_at | NCOR1 | 145 | 0.130891 |
| 204224_s_at | GCH1 | 144 | −0.14574 |
| 202028_s_at | — | 144 | 0.094276 |
| 201735_s_at | CLCN3 | 144 | −0.1434 |
| 208447_s_at | PRPS1 | 143 | −0.14933 |
| 220926_s_at | C1orf22 | 142 | −0.17477 |
| 211505_s_at | STAU | 142 | −0.11618 |
| 221684_s_at | NYX | 142 | 0.102298 |
| 206906_at | ICAM5 | 141 | 0.076813 |
| 213228_at | PDE8B | 140 | −0.13728 |
| 217202_s_at | GLUL | 139 | −0.15489 |
| 211713_x_at | KIAA0101 | 138 | 0.108672 |
| 215012_at | ZNF451 | 138 | 0.13269 |
| 200806_s_at | HSPD1 | 137 | −0.14811 |
| 201466_s_at | JUN | 135 | −0.0667 |
| 211564_s_at | PDLIM4 | 134 | −0.12756 |
| 207850_at | CXCL3 | 133 | −0.17973 |
| 221841_s_at | KLF4 | 133 | −0.1415 |
| 200605_s_at | PRKAR1A | 132 | −0.15642 |
| 221198_at | SCT | 132 | 0.08221 |
| 201772_at | AZIN1 | 131 | −0.16639 |

TABLE 6-continued

Group of 535 genes useful in prognosis or diagnosis of lung cancer.

| Affymetrix probe ID No. that can be used to identify the gene/nucleic acid sequence in the next column | Gene symbol | Number of runs the gene is indicated in cancer samples as differentially expressed out of 1000 test runs | Signal to noise in a cancer sample. Negative values indicate increase of expression in lung cancer, positive values indicate decrease of expression in lung cancer. |
|---|---|---|---|
| 205009_at | TFF1 | 130 | −0.17578 |
| 205542_at | STEAP1 | 129 | −0.08498 |
| 218195_at | C6orf211 | 129 | −0.14497 |
| 213642_at | — | 128 | 0.079657 |
| 212891_s_at | GADD45GIP1 | 128 | −0.09272 |
| 202798_at | SEC24B | 127 | −0.12621 |
| 222207_x_at | — | 127 | 0.10783 |
| 202638_s_at | ICAM1 | 126 | 0.070364 |
| 200730_s_at | PTP4A1 | 126 | −0.15289 |
| 219355_at | FLJ10178 | 126 | −0.13407 |
| 220266_s_at | KLF4 | 126 | −0.15324 |
| 201259_s_at | SYPL | 124 | −0.16643 |
| 209649_at | STAM2 | 124 | −0.1696 |
| 220094_s_at | C6orf79 | 123 | −0.12214 |
| 221751_at | PANK3 | 123 | −0.1723 |
| 200008_s_at | GDI2 | 123 | −0.15852 |
| 205078_at | PIGF | 121 | −0.13747 |
| 218842_at | FLJ21908 | 121 | −0.08903 |
| 202536_at | CHMP2B | 121 | −0.14745 |
| 220184_at | NANOG | 119 | 0.098142 |
| 201117_s_at | CPE | 118 | −0.20025 |
| 219787_s_at | ECT2 | 117 | −0.14278 |
| 206628_at | SLC5A1 | 117 | −0.12838 |
| 204007_at | FCGR3B | 116 | −0.15337 |
| 209446_s_at | — | 116 | 0.100508 |
| 211612_s_at | IL13RA1 | 115 | −0.17266 |
| 220992_s_at | C1orf25 | 115 | −0.11026 |
| 221899_at | PFAAP5 | 115 | 0.11698 |
| 221719_s_at | LZTS1 | 115 | 0.093494 |
| 201473_at | JUNB | 114 | −0.10249 |
| 221193_s_at | ZCCHC10 | 112 | −0.08003 |
| 215659_at | GSDML | 112 | 0.118288 |
| 205157_s_at | KRT17 | 111 | −0.14232 |
| 201001_s_at | UBE2V1 /// Kua-UEV | 111 | −0.16786 |
| 216789_at | — | 111 | 0.105386 |
| 205506_at | VIL1 | 111 | 0.097452 |
| 204875_s_at | GMDS | 110 | −0.12995 |
| 207191_s_at | ISLR | 110 | 0.100627 |
| 202779_s_at | UBE2S | 109 | −0.11364 |
| 210370_s_at | LY9 | 109 | 0.096323 |
| 202842_s_at | DNAJB9 | 108 | −0.15326 |
| 201082_s_at | DCTN1 | 107 | −0.10104 |
| 215588_x_at | RIOK3 | 107 | 0.135837 |
| 211076_x_at | DRPLA | 107 | 0.102743 |
| 210230_at | — | 106 | 0.115001 |
| 206544_x_at | SMARCA2 | 106 | −0.12099 |
| 208852_s_at | CANX | 105 | −0.14776 |
| 215405_at | MYO1E | 105 | 0.086393 |
| 208653_s_at | CD164 | 104 | −0.09185 |
| 206355_at | GNAL | 103 | 0.1027 |
| 210793_s_at | NUP98 | 103 | −0.13244 |
| 215070_x_at | RABGAP1 | 103 | 0.125029 |
| 203007_x_at | LYPLA1 | 102 | −0.17961 |
| 203841_x_at | MAPRE3 | 102 | −0.13389 |
| 206759_at | FCER2 | 102 | 0.081733 |
| 202232_s_at | GA17 | 102 | −0.11373 |
| 215892_at | — | 102 | 0.13866 |
| 214359_s_at | HSPCB | 101 | −0.12276 |
| 215810_x_at | DST | 101 | 0.098963 |
| 208937_s_at | ID1 | 100 | −0.06552 |
| 213664_at | SLC1A1 | 100 | −0.12654 |
| 219338_s_at | FLJ20156 | 100 | −0.10332 |
| 206595_at | CST6 | 99 | −0.10059 |
| 207300_s_at | F7 | 99 | 0.082445 |
| 213792_s_at | INSR | 98 | 0.137962 |
| 209674_at | CRY1 | 98 | −0.13818 |
| 40665_at | FMO3 | 97 | −0.05976 |
| 217975_at | WBP5 | 97 | −0.12698 |
| 210296_s_at | PXMP3 | 97 | −0.13537 |
| 215483_at | AKAP9 | 95 | 0.125966 |
| 212633_at | KIAA0776 | 95 | −0.16778 |

TABLE 6-continued

Group of 535 genes useful in prognosis or diagnosis of lung cancer.

| Affymetrix probe ID No. that can be used to identify the gene/nucleic acid sequence in the next column | Gene symbol | Number of runs the gene is indicated in cancer samples as differentially expressed out of 1000 test runs | Signal to noise in a cancer sample. Negative values indicate increase of expression in lung cancer, positive values indicate decrease of expression in lung cancer. |
|---|---|---|---|
| 206164_at | CLCA2 | 94 | −0.13117 |
| 216813_at | — | 94 | 0.089023 |
| 208925_at | C3orf4 | 94 | −0.1721 |
| 219469_at | DNCH2 | 94 | −0.12003 |
| 206016_at | CXorf37 | 93 | −0.11569 |
| 216745_x_at | LRCH1 | 93 | 0.117149 |
| 212999_x_at | HLA-DQB1 | 92 | 0.110258 |
| 216859_x_at | — | 92 | 0.116351 |
| 201636_at | — | 92 | −0.13501 |
| 204272_at | LGALS4 | 92 | 0.110391 |
| 215454_x_at | SFTPC | 91 | 0.064918 |
| 215972_at | — | 91 | 0.097654 |
| 220593_s_at | FLJ20753 | 91 | 0.095702 |
| 222009_at | CGI-14 | 91 | 0.070949 |
| 207115_x_at | MBTD1 | 91 | 0.107883 |
| 216922_x_at | DAZ1 /// DAZ3 /// DAZ2 /// DAZ4 | 91 | 0.086888 |
| 217626_at | AKR1C1 /// AKR1C2 | 90 | 0.036545 |
| 211429_s_at | SERPINA1 | 90 | −0.11406 |
| 209662_at | CETN3 | 90 | −0.10879 |
| 201629_s_at | ACP1 | 90 | −0.14441 |
| 201236_s_at | BTG2 | 89 | −0.09435 |
| 217137_x_at | — | 89 | 0.070954 |
| 212476_at | CENTB2 | 89 | −0.1077 |
| 218545_at | FLJ11088 | 89 | −0.12452 |
| 208857_s_at | PCMT1 | 89 | −0.14704 |
| 221931_s_at | SEH1L | 88 | −0.11491 |
| 215046_at | FLJ23861 | 88 | −0.14667 |
| 220222_at | PRO1905 | 88 | 0.081524 |
| 209737_at | AIP1 | 87 | −0.07696 |
| 203949_at | MPO | 87 | 0.113273 |
| 219290_x_at | DAPP1 | 87 | 0.111366 |
| 205116_at | LAMA2 | 86 | 0.05845 |
| 222316_at | VDP | 86 | 0.091505 |
| 203574_at | NFIL3 | 86 | −0.14335 |
| 207820_at | ADH1A | 86 | 0.104444 |
| 203751_x_at | JUND | 85 | −0.14118 |
| 202930_s_at | SUCLA2 | 85 | −0.14884 |
| 215404_x_at | FGFR1 | 85 | 0.119684 |
| 216266_s_at | ARFGEF1 | 85 | −0.12432 |
| 212806_at | KIAA0367 | 85 | −0.13259 |
| 219253_at | — | 83 | −0.14094 |
| 214605_x_at | GPR1 | 83 | 0.114443 |
| 205403_at | IL1R2 | 82 | −0.19721 |
| 222282_at | PAPD4 | 82 | 0.128004 |
| 214129_at | PDE4DIP | 82 | −0.13913 |
| 209259_s_at | CSPG6 | 82 | −0.12618 |
| 216900_s_at | CHRNA4 | 82 | 0.105518 |
| 221943_x_at | RPL38 | 80 | 0.086719 |
| 215386_at | AUTS2 | 80 | 0.129921 |
| 201990_s_at | CREBL2 | 80 | −0.13645 |
| 220145_at | FLJ21159 | 79 | −0.16097 |
| 221173_at | USH1C | 79 | 0.109348 |
| 214900_at | ZKSCAN1 | 79 | 0.075517 |
| 203290_at | HLA-DQA1 | 78 | −0.20756 |
| 215382_x_at | TPSAB1 | 78 | −0.09041 |
| 201631_s_at | IER3 | 78 | −0.12038 |
| 212188_at | KCTD12 | 77 | −0.14672 |
| 220428_at | CD207 | 77 | 0.101238 |
| 215349_at | — | 77 | 0.10172 |
| 213928_s_at | HRB | 77 | 0.092136 |
| 221228_s_at | — | 77 | 0.0859 |
| 202069_s_at | IDH3A | 76 | −0.14747 |
| 208554_at | POU4F3 | 76 | 0.107529 |
| 209504_s_at | PLEKHB1 | 76 | −0.13125 |
| 212989_at | TMEM23 | 75 | −0.11012 |
| 216197_at | ATF7IP | 75 | 0.115016 |
| 204748_at | PTGS2 | 74 | −0.15194 |
| 205221_at | HGD | 74 | 0.096171 |
| 214705_at | INADL | 74 | 0.102919 |
| 213939_s_at | RIPX | 74 | 0.091175 |
| 203691_at | PI3 | 73 | −0.14375 |

TABLE 6-continued

Group of 535 genes useful in prognosis or diagnosis of lung cancer.

| Affymetrix probe ID No. that can be used to identify the gene/nucleic acid sequence in the next column | Gene symbol | Number of runs the gene is indicated in cancer samples as differentially expressed out of 1000 test runs | Signal to noise in a cancer sample. Negative values indicate increase of expression in lung cancer, positive values indicate decrease of expression in lung cancer. |
|---|---|---|---|
| 220532_s_at | LR8 | 73 | −0.11682 |
| 209829_at | C6orf32 | 73 | −0.08982 |
| 206515_at | CYP4F3 | 72 | 0.104171 |
| 218541_s_at | C8orf4 | 72 | −0.09551 |
| 210732_s_at | LGALS8 | 72 | −0.13683 |
| 202643_s_at | TNFAIP3 | 72 | −0.16699 |
| 218963_s_at | KRT23 | 72 | −0.10915 |
| 213304_at | KIAA0423 | 72 | −0.12256 |
| 202768_at | FOSB | 71 | −0.06289 |
| 205623_at | ALDH3A1 | 71 | 0.045457 |
| 206488_s_at | CD36 | 71 | −0.15899 |
| 204319_s_at | RGS10 | 71 | −0.10107 |
| 217811_at | SELT | 71 | −0.16162 |
| 202746_at | ITM2A | 70 | −0.06424 |
| 221127_s_at | RIG | 70 | 0.110593 |
| 209821_at | C9orf26 | 70 | −0.07383 |
| 220957_at | CTAGE1 | 70 | 0.092986 |
| 215577_at | UBE2E1 | 70 | 0.10305 |
| 214731_at | DKFZp547A023 | 70 | 0.102821 |
| 210512_s_at | VEGF | 69 | −0.11804 |
| 205267_at | POU2AF1 | 69 | 0.101353 |
| 216202_s_at | SPTLC2 | 69 | −0.11908 |
| 220477_s_at | C20orf30 | 69 | −0.16221 |
| 205863_at | S100A12 | 68 | −0.10353 |
| 215780_s_at | SET /// LOC389168 | 68 | −0.10381 |
| 218197_s_at | OXR1 | 68 | −0.14424 |
| 203077_s_at | SMAD2 | 68 | −0.11242 |
| 222339_x_at | — | 68 | 0.121585 |
| 200698_at | KDELR2 | 68 | −0.15907 |
| 210540_s_at | B4GALT4 | 67 | −0.13556 |
| 217725_x_at | PAI-RBP1 | 67 | −0.14956 |
| 217082_at | — | 67 | 0.086098 |

TABLE 7

Group of 20 genes useful in prognosis and/or diagnosis of lung cancer.

| Affymetrix probe ID No. that can be used to identify the gene/nucleic acid sequence in the next column | Gene symbol | Number of runs the gene is indicated in cancer samples as differentially expressed out of 1000 test runs | Signal to noise in a cancer sample. Negative values indicate increase of expression in lung cancer, positive values indicate decrease of expression in lung cancer. |
|---|---|---|---|
| 207953_at | AD7C-NTP | 1000 | 0.218433 |
| 215208_x_at | RPL35A | 999 | 0.228485 |
| 215604_x_at | UBE2D2 | 998 | 0.224878 |
| 218155_x_at | FLJ10534 | 998 | 0.186425 |
| 216858_x_at | — | 997 | 0.232969 |
| 208137_x_at | — | 996 | 0.191938 |
| 214715_x_at | ZNF160 | 996 | 0.198532 |
| 217715_x_at | ZNF354A | 995 | 0.223881 |
| 220720_x_at | FLJ14346 | 989 | 0.17976 |
| 215907_at | BACH2 | 987 | 0.178338 |
| 217679_x_at | — | 987 | 0.265918 |
| 206169_x_at | RoXaN | 984 | 0.259637 |
| 208246_x_at | TK2 | 982 | 0.179058 |
| 222104_x_at | GTF2H3 | 981 | 0.186625 |
| 206056_x_at | SPN | 976 | 0.196398 |
| 217653_x_at | — | 976 | 0.270552 |
| 210679_x_at | — | 970 | 0.481718 |
| 207730_x_at | HDGF2 | 969 | 0.169108 |
| 214594_x_at | ATP8B1 | 962 | 0.284039 |

One can use the above tables to correlate or compare the expression of the transcript to the expression of the gene product. Increased expression of the transcript as shown in the table corresponds to increased expression of the gene product. Similarly, decreased expression of the transcript as shown in the table corresponds to decreased expression of the gene product The analysis of the gene expression of one or more genes and/or transcripts of the groups or their subgroups of the present invention can be performed using any gene expression method known to one skilled in the art. Such methods include, but are not limited to expression analysis using nucleic acid chips (e.g. Affymetrix chips) and quantitative RT-PCR based methods using, for example real-time detection of the transcripts. Analysis of transcript levels according to the present invention can be made using total or messenger RNA or proteins encoded by the genes identified in the diagnostic gene groups of the present invention as a starting material. In the preferred embodiment the analysis is an immunohistochemical analysis with an antibody directed against proteins comprising at least about 10-20, 20-30, preferably at least 36, at least 36-50, 50, about 50-60, 60-70, 70-80, 80-90, 96, 100-180, 180-200, 200-250, 250-300, 300-350, 350-400, 400-450, 450-500, 500-535 proteins encoded by the genes and/or transcripts as shown in Tables 1-7.

The methods of analyzing transcript levels of the gene groups in an individual include Northern-blot hybridization, ribonuclease protection assay, and reverse transcriptase polymerase chain reaction (RT-PCR) based methods. The different RT-PCR based techniques are the most suitable quantification method for diagnostic purposes of the present invention, because they are very sensitive and thus require only a small sample size which is desirable for a diagnostic test. A number of quantitative RT-PCR based methods have been described and are useful in measuring the amount of transcripts according to the present invention. These methods include RNA quantification using PCR and complementary DNA (cDNA) arrays (Shalon et al., Genome Research 6(7):639-45, 1996; Bernard et al., Nucleic Acids Research 24(8): 1435-42, 1996), real competitive PCR using a MALDI-TOF Mass spectrometry based approach (Ding et al, PNAS, 100: 3059-64, 2003), solid-phase mini-sequencing technique, which is based upon a primer extension reaction (U.S. Pat. No. 6,013,431, Suomalainen et al. Mol. Biotechnol. June; 15(2): 123-31, 2000), ion-pair high-performance liquid chromatography (Doris et al. J. Chromatogr. A May 8; 806(1):47-60, 1998), and 5' nuclease assay or real-time RT-PCR (Holland et al. Proc Natl Acad Sci USA 88: 7276-7280, 1991).

Methods using RT-PCR and internal standards differing by length or restriction endonuclease site from the desired target sequence allowing comparison of the standard with the target using gel electrophoretic separation methods followed by densitometric quantification of the target have also been developed and can be used to detect the amount of the transcripts according to the present invention (see, e.g., U.S. Pat. Nos. 5,876,978; 5,643,765; and 5,639,606.

The samples are preferably obtained from bronchial airways using, for example, endoscopic cytobrush in connection with a fiber optic bronchoscopy. In one embodiment, the cells are obtained from the individual's mouth buccal cells, using, for example, a scraping of the buccal mucosa.

In one preferred embodiment, the invention provides a prognostic and/or diagnostic immunohistochemical approach, such as a dip-stick analysis, to determine risk of developing lung disease. Antibodies against proteins, or antigenic epitopes thereof, that are encoded by the group of genes of the present invention, are either commercially available or can be produced using methods well know to one skilled in the art.

The invention contemplates either one dipstick capable of detecting all the diagnostically important gene products or alternatively, a series of dipsticks capable of detecting the amount proteins of a smaller sub-group of diagnostic proteins of the present invention.

Antibodies can be prepared by means well known in the art. The term "antibodies" is meant to include monoclonal antibodies, polyclonal antibodies and antibodies prepared by recombinant nucleic acid techniques that are selectively reactive with a desired antigen. Antibodies against the proteins encoded by any of the genes in the diagnostic gene groups of the present invention are either known or can be easily produced using the methods well known in the art. Internet sites such as Biocompare through the World Wide Web at "biocompare.com/abmatrix.asp?antibody=y" provide a useful tool to anyone skilled in the art to locate existing antibodies against any of the proteins provided according to the present invention.

Antibodies against the diagnostic proteins according to the present invention can be used in standard techniques such as Western blotting or immunohistochemistry to quantify the level of expression of the proteins of the diagnostic airway proteome. This is quantified according to the expression of the gene transcript, i.e. the increased expression of transcript corresponds to increased expression of the gene product, i.e. protein. Similarly decreased expression of the transcript corresponds to decreased expression of the gene product or protein. Detailed guidance of the increase or decrease of expression of preferred transcripts in lung disease, particularly lung cancer, is set forth in the tables. For example, Tables 5 and 6 describe a group of genes the expression of which is altered in lung cancer.

Immunohistochemical applications include assays, wherein increased presence of the protein can be assessed, for example, from a saliva or sputum sample.

The immunohistochemical assays according to the present invention can be performed using methods utilizing solid supports. The solid support can be a any phase used in performing immunoassays, including dipsticks, membranes, absorptive pads, beads, microtiter wells, test tubes, and the like. Preferred are test devices which may be conveniently used by the testing personnel or the patient for self-testing, having minimal or no previous training. Such preferred test devices include dipsticks, membrane assay systems as described in U.S. Pat. No. 4,632,901. The preparation and use of such conventional test systems is well described in the patent, medical, and scientific literature. If a stick is used, the anti-protein antibody is bound to one end of the stick such that the end with the antibody can be dipped into the solutions as described below for the detection of the protein. Alternatively, the samples can be applied onto the antibody-coated dipstick or membrane by pipette or dropper or the like.

The antibody against proteins encoded by the diagnostic airway transcriptome (the "protein") can be of any isotype, such as IgA, IgG or IgM, Fab fragments, or the like. The antibody may be a monoclonal or polyclonal and produced by methods as generally described, for example, in Harlow and Lane, Antibodies, A Laboratory Manual, Cold Spring Harbor Laboratory, 1988, incorporated herein by reference. The antibody can be applied to the solid support by direct or indirect means. Indirect bonding allows maximum exposure of the protein binding sites to the assay solutions since the sites are not themselves used for binding to the support. Preferably, polyclonal antibodies are used since polyclonal antibodies can recognize different epitopes of the protein thereby enhancing the sensitivity of the assay.

The solid support is preferably non-specifically blocked after binding the protein antibodies to the solid support. Non-specific blocking of surrounding areas can be with whole or derivatized bovine serum albumin, or albumin from other animals, whole animal serum, casein, non-fat milk, and the like.

The sample is applied onto the solid support with bound protein-specific antibody such that the protein will be bound to the solid support through said antibodies. Excess and unbound components of the sample are removed and the solid support is preferably washed so the antibody-antigen complexes are retained on the solid support. The solid support may be washed with a washing solution which may contain a detergent such as Tween-20, Tween-80 or sodium dodecyl sulfate.

After the protein has been allowed to bind to the solid support, a second antibody which reacts with protein is applied. The second antibody may be labeled, preferably with a visible label. The labels may be soluble or particulate and may include dyed immunoglobulin binding substances, simple dyes or dye polymers, dyed latex beads, dye-containing liposomes, dyed cells or organisms, or metallic, organic, inorganic, or dye solids. The labels may be bound to the protein antibodies by a variety of means that are well known in the art. In some embodiments of the present invention, the labels may be enzymes that can be coupled to a signal producing system. Examples of visible labels include alkaline phosphatase, beta-galactosidase, horseradish peroxidase, and biotin. Many enzyme-chromogen or enzyme-substrate-chromogen combinations are known and used for enzyme-linked assays. Dye labels also encompass radioactive labels and fluorescent dyes.

Simultaneously with the sample, corresponding steps may be carried out with a known amount or amounts of the protein and such a step can be the standard for the assay. A sample from a healthy individual exposed to a similar air pollutant such as cigarette smoke, can be used to create a standard for any and all of the diagnostic gene group encoded proteins.

The solid support is washed again to remove unbound labeled antibody and the labeled antibody is visualized and quantified. The accumulation of label will generally be assessed visually. This visual detection may allow for detection of different colors, for example, red color, yellow color, brown color, or green color, depending on label used. Accumulated label may also be detected by optical detection devices such as reflectance analyzers, video image analyzers and the like. The visible intensity of accumulated label could correlate with the concentration of protein in the sample. The correlation between the visible intensity of accumulated label and the amount of the protein may be made by comparison of the visible intensity to a set of reference standards. Preferably, the standards have been assayed in the same way as the unknown sample, and more preferably alongside the sample, either on the same or on a different solid support.

The concentration of standards to be used can range from about 1 mg of protein per liter of solution, up to about 50 mg of protein per liter of solution. Preferably, two or more different concentrations of an airway gene group encoded proteins are used so that quantification of the unknown by comparison of intensity of color is more accurate.

For example, the present invention provides a method for detecting risk of developing lung cancer in a subject exposed to cigarette smoke comprising measuring the transcription profile of the proteins encoded by one or more groups of genes of the invention in a biological sample of the subject. Preferably at least about 30, still more preferably at least about 36, 40, 50, 60, 70, 80, 90, 100, 110, 120, 130, 140, 150, 160, 170, or about 180 of the proteins encoded by the airway transcriptome in a biological sample of the subject are analyzed. The method comprises binding an antibody against each protein encoded by the gene in the gene group (the "protein") to a solid support chosen from the group consisting of dip-stick and membrane; incubating the solid support in the presence of the sample to be analyzed under conditions where antibody-antigen complexes form; incubating the support with an anti-protein antibody conjugated to a detectable moiety which produces a signal; visually detecting said signal, wherein said signal is proportional to the amount of protein in said sample; and comparing the signal in said sample to a standard, wherein a difference in the amount of the protein in the sample compared to said standard of the same group of proteins, is indicative of diagnosis of or an increased risk of developing lung cancer. The standard levels are measured to indicate expression levels in an airway exposed to cigarette smoke where no cancer has been detected.

The assay reagents, pipettes/dropper, and test tubes may be provided in the form of a kit. Accordingly, the invention further provides a test kit for visual detection of the proteins encoded by the airway gene groups, wherein detection of a level that differs from a pattern in a control individual is considered indicative of an increased risk of developing lung disease in the subject. The test kit comprises one or more solutions containing a known concentration of one or more proteins encoded by the airway transcriptome (the "protein") to serve as a standard; a solution of a anti-protein antibody bound to an enzyme; a chromogen which changes color or shade by the action of the enzyme; a solid support chosen from the group consisting of dip-stick and membrane carrying on the surface thereof an antibody to the protein. Instructions including the up or down regulation of the each of the genes in the groups as provided by the Tables 1 and 2 are included with the kit.

The practice of the present invention may employ, unless otherwise indicated, conventional techniques and descriptions of organic chemistry, polymer technology, molecular biology (including recombinant techniques), cell biology, biochemistry, and immunology, which are within the skill of the art. Such conventional techniques include polymer array synthesis, hybridization, ligation, and detection of hybridization using a label. Specific illustrations of suitable techniques can be had by reference to the example herein below. However, other equivalent conventional procedures can, of course, also be used. Such conventional techniques and descriptions can be found in standard laboratory manuals such as Genome Analysis: A Laboratory Manual Series (Vols. I-IV), Using Antibodies: A Laboratory Manual, Cells: A Laboratory Manual, PCR Primer: A Laboratory Manual, and Molecular Cloning: A Laboratory Manual (all from Cold Spring Harbor Laboratory Press), Stryer, L. (1995) *Biochemistry* (4th Ed.) Freeman, N.Y., Gait, "*Oligonucleotide Synthesis: A Practical Approach*" 1984, IRL Press, London, Nelson and Cox (2000), *Lehninger, Principles of Biochemistry* $3^{rd}$ Ed., W. H. Freeman Pub., New York, N.Y. and Berg et al. (2002) *Biochemistry*, $5^{th}$ Ed., W.H. Freeman Pub., New York, N.Y., all of which are herein incorporated in their entirety by reference for all purposes.

The methods of the present invention can employ solid substrates, including arrays in some preferred embodiments. Methods and techniques applicable to polymer (including protein) array synthesis have been described in U.S. Ser. No. 09/536,841, WO 00/58516, U.S. Pat. Nos. 5,143,854, 5,242, 974, 5,252,743, 5,324,633, 5,384,261, 5,405,783, 5,424,186, 5,451,683, 5,482,867, 5,491,074, 5,527,681, 5,550,215, 5,571,639, 5,578,832, 5,593,839, 5,599,695, 5,624,711, 5,631,734, 5,795,716, 5,831,070, 5,837,832, 5,856,101, 5,858,659, 5,936,324, 5,968,740, 5,974,164, 5,981,185, 5,981,956, 6,025,601, 6,033,860, 6,040,193, 6,090,555, 6,136,269, 6,269,846 and 6,428,752, in PCT Applications Nos. PCT/US99/00730 (International Publication Number WO 99/36760) and PCT/US01/04285, which are all incorporated herein by reference in their entirety for all purposes.

Patents that describe synthesis techniques in specific embodiments include U.S. Pat. Nos. 5,412,087, 6,147,205, 6,262,216, 6,310,189, 5,889,165, and 5,959,098. Nucleic acid arrays are described in many of the above patents, but the same techniques are applied to polypeptide and protein arrays.

Nucleic acid arrays that are useful in the present invention include, but are not limited to those that are commercially available from Affymetrix (Santa Clara, Calif.) under the brand name GeneChip7. Example arrays are shown on the website at affymetrix.com.

Examples of gene expression monitoring, and profiling methods that are useful in the methods of the present invention are shown in U.S. Pat. Nos. 5,800,992, 6,013,449, 6,020,135, 6,033,860, 6,040,138, 6,177,248 and 6,309,822.

Other examples of uses are embodied in U.S. Pat. Nos. 5,871,928, 5,902,723, 6,045,996, 5,541,061, and 6,197,506.

The present invention also contemplates sample preparation methods in certain preferred embodiments. Prior to or concurrent with expression analysis, the nucleic acid sample may be amplified by a variety of mechanisms, some of which may employ PCR. See, e.g., *PCR Technology: Principles and Applications for DNA Amplification* (Ed. H. A. Erlich, Freeman Press, NY, N.Y., 1992); *PCR Protocols: A Guide to Methods and Applications* (Eds. Innis, et al., Academic Press, San Diego, Calif., 1990); Mattila et al., *Nucleic Acids Res.* 19, 4967 (1991); Eckert et al., *PCR Methods and Applications* 1, 17 (1991); *PCR* (Eds. McPherson et al., IRL Press, Oxford); and U.S. Pat. Nos. 4,683,202, 4,683,195, 4,800,159 4,965,188, and 5,333,675, and each of which is incorporated herein by reference in their entireties for all purposes. The sample may be amplified on the array. See, for example, U.S. Pat. No. 6,300,070 and U.S. patent application Ser. No. 09/513,300, which are incorporated herein by reference.

Other suitable amplification methods include the ligase chain reaction (LCR) (e.g., Wu and Wallace, *Genomics* 4, 560 (1989), Landegren et al., *Science* 241, 1077 (1988) and Barringer et al. *Gene* 89:117 (1990)), transcription amplification (Kwoh et al., *Proc. Natl. Acad. Sci. USA* 86, 1173 (1989) and WO88/10315), self-sustained sequence replication (Guatelli et al., *Proc. Nat. Acad Sci. USA,* 87, 1874 (1990) and WO90/06995), selective amplification of target polynucleotide sequences (U.S. Pat. No. 6,410,276), consensus sequence primed polymerase chain reaction (CP-PCR) (U.S. Pat. No. 4,437,975), arbitrarily primed polymerase chain reaction (AP-PCR) (U.S. Pat. Nos. 5,413,909, 5,861,245) and nucleic acid based sequence amplification (NABSA). (U.S. Pat. Nos. 5,409,818, 5,554,517, and 6,063,603). Other amplification methods that may be used are described in, U.S. Pat. Nos. 5,242,794, 5,494,810, 4,988,617 and in U.S. Ser. No. 09/854,317, each of which is incorporated herein by reference.

Additional methods of sample preparation and techniques for reducing the complexity of a nucleic sample are described, for example, in Dong et al., *Genome Research* 11, 1418 (2001), in U.S. Pat. Nos. 6,361,947, 6,391,592 and U.S. patent application Ser. Nos. 09/916,135, 09/920,491, 09/910,292, and 10/013,598.

Methods for conducting polynucleotide hybridization assays have been well developed in the art. Hybridization assay procedures and conditions will vary depending on the application and are selected in accordance with the general binding methods known including those referred to in: Maniatis et al. *Molecular Cloning: A Laboratory Manual* ($2^{nd}$ Ed. Cold Spring Harbor, N.Y., 1989); Berger and Kimmel *Methods in Enzymology,* Vol. 152, *Guide to Molecular Cloning Techniques* (Academic Press, Inc., San Diego, Calif., 1987); Young and Davism, *P.N. A.S,* 80: 1194 (1983). Methods and apparatus for carrying out repeated and controlled hybridization reactions have been described, for example, in U.S. Pat. Nos. 5,871,928, 5,874,219, 6,045,996 and 6,386,749, 6,391,623 each of which are incorporated herein by reference The present invention also contemplates signal detection of hybridization between the sample and the probe in certain embodiments. See, for example, U.S. Pat. Nos. 5,143,854, 5,578,832; 5,631,734; 5,834,758; 5,936,324; 5,981,956; 6,025,601; 6,141,096; 6,185,030; 6,201,639; 6,218,803; and 6,225,625, in provisional U.S. patent application Ser. No. 60/364,731 and in PCT Application PCT/US99/06097 (published as WO99/47964).

Examples of methods and apparatus for signal detection and processing of intensity data are disclosed in, for example, U.S. Pat. Nos. 5,143,854, 5,547,839, 5,578,832, 5,631,734, 5,800,992, 5,834,758; 5,856,092, 5,902,723, 5,936,324, 5,981,956, 6,025,601, 6,090,555, 6,141,096, 6,185,030, 6,201,639; 6,218,803; and 6,225,625, in U.S. patent application Ser. No. 60/364,731 and in PCT Application PCT/US99/06097 (published as WO99/47964).

The practice of the present invention may also employ conventional biology methods, software and systems. Computer software products of the invention typically include computer readable medium having computer-executable instructions for performing the logic steps of the method of the invention. Suitable computer readable medium include floppy disk, CD-ROM/DVD/DVD-ROM, hard-disk drive, flash memory, ROM/RAM, magnetic tapes and etc. The computer executable instructions may be written in a suitable computer language or combination of several languages. Basic computational biology methods are described in, e.g. Setubal and Meidanis et al., *Introduction to Computational Biology Methods* (PWS Publishing Company, Boston, 1997); Salzberg, Searles, Kasif, (Ed.), *Computational Methods in Molecular Biology*, (Elsevier, Amsterdam, 1998); Rashidi and Buehler, *Bioinformatics Basics: Application in Biological Science and Medicine* (CRC Press, London, 2000) and Ouelette and Bzevanis *Bioinformatics: A Practical Guide for Analysis of Gene and Proteins* (Wiley & Sons, Inc., $2^{nd}$ ed., 2001).

The present invention also makes use of various computer program products and software for a variety of purposes, such as probe design, management of data, analysis, and instrument operation. See, for example, U.S. Pat. Nos. 5,593,839, 5,795,716, 5,733,729, 5,974,164, 6,066,454, 6,090,555, 6,185,561, 6,188,783, 6,223,127, 6,229,911 and 6,308,170.

Additionally, the present invention may have embodiments that include methods for providing gene expression profile information over networks such as the Internet as shown in, for example, U.S. patent application Ser. Nos. 10/063,559, 60/349,546, 60/376,003, 60/394,574, 60/403, 381.

Throughout this specification, various aspects of this invention are presented in a range format. It should be understood that the description in range format is merely for convenience and brevity and should not be construed as an inflexible limitation on the scope of the invention. Accordingly, the description of a range should be considered to have specifically disclosed all the possible sub-ranges as well as individual numerical values within that range. For example, description of a range such as from 10-20 should be considered to have specifically disclosed sub-ranges such as from 10-13, from 10-14, from 10-15, from 11-14, from 11-16, etc., as well as individual numbers within that range, for example, 10, 11, 12, 13, 14, 15, 16, 17, 18, 19, and 20. This applies regardless of the breadth of the range. In addition, the fractional ranges are also included in the exemplified amounts that are described. Therefore, for example, a range of 1-3 includes fractions such as 1.1, 1.2, 1.3, 1.4, 1.5, 1.6, etc. This applies particularly to the amount of increase or decrease of expression of any particular gene or transcript.

The present invention has many preferred embodiments and relies on many patents, applications and other references for details known to those of the art. Therefore, when a patent, application, or other reference is cited or repeated throughout the specification, it should be understood that it is incorporated by reference in its entirety for all purposes as well as for the proposition that is recited.

EXAMPLES

Example 1

In this study, we used three study groups: 1) normal non-smokers (n=23); 2) smokers without cancer (active v. former smokers) (n=52); 3) smokers with suspect cancer (n=98: 45 cancer, 53 no cancer).

We obtained epithelial nucleic acids (RNA/DNA) from epithelial cells in mouth and airway (bronchoscopy). We also obtained nucleic acids from blood to provide one control.

We analyzed gene expression using RNA and U133A Affymetrix array that represents transcripts from about 22,500 genes.

The microarray data analysis was performed as follows. We first scanned the Affymetrix chips that had been hybridized with the study group samples. The obtained microarray raw data consisted of signal strength and detection p-value. We normalized or scaled the data, and filtered the poor quality chips based on images, control probes, and histograms according to standard Affymetrix instructions. We also filtered contaminated specimens which contained non-epithelial cells. Lastly, the genes of importance were filtered using detection p-value. This resulted in identification of transcripts present in normal airways (normal airway transcriptome), with variability and multiple regression analysis. This also resulted in identification of effects of smoking on airway epithelial cell transcription. For this, we used T-test and Pearson correlation analysis. We also identified a group or a set of transcripts that were differentially expressed in samples with lung cancer and samples without cancer. This analysis was performed using class prediction models.

We used weighted voting method. The weighted voting method ranks, and gives a weight "p" to all genes by the signal to noise ration of gene expression between two classes: $P=mean_{(class\ 1)}-mean_{(class2)}/sd_{(class\ 1)}=sd_{(class\ 2)}$. Committees of variable sizes of the top ranked genes were used to evaluate test samples, but genes with more significant p-values were more heavily weighed. Each committee genes in test sample votes for one class or the other, based on how close that gene expression level is to the class 1 mean or the class 2 mean. $V_{(gene\ A)}=P_{(gene\ A)}$, i.e. level of expression in test sample less the average of the mean expression values in the two classes. Votes for each class were tallied and the winning class was determined along with prediction strength as $PS=V_{win}-V_{lose}/V_{win}+V_{lose}$. Finally, the accuracy was validated using cross-validation +/− independent samples.

Figure 8:
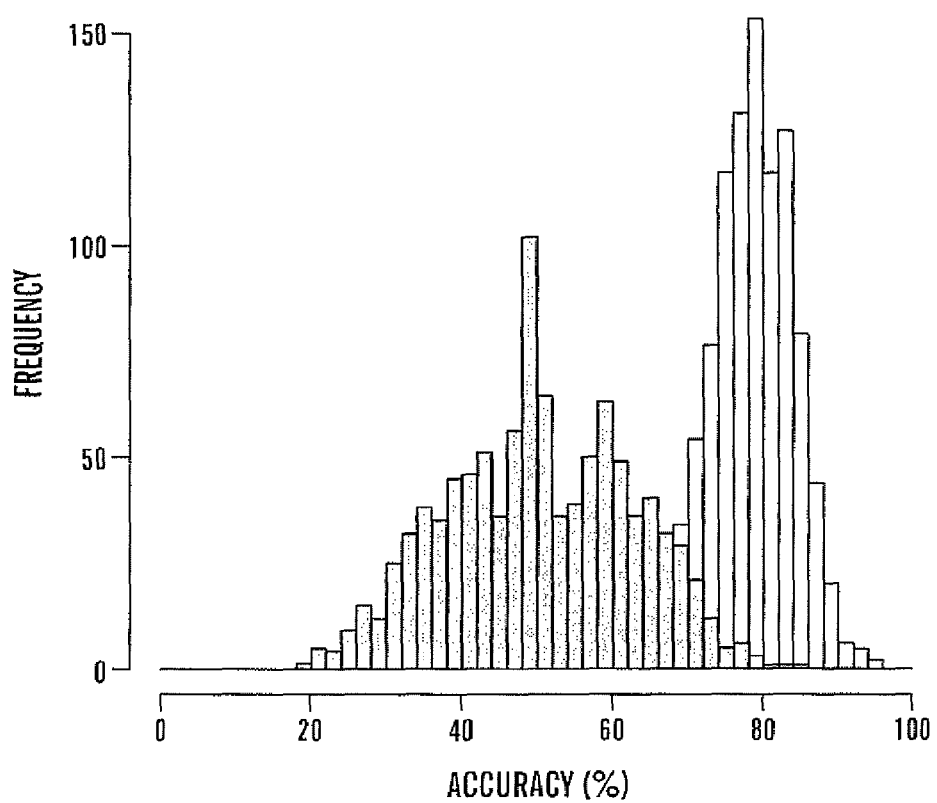
FIG. 8 shows distribution of accuracies for real vs. random 1000 runs. Histogram comparing test set class prediction accuracies of 1000 "sample randomized" classifiers generated by randomly assigning samples into training and test sets with true class labels (unshaded) versus 1000 "sample and class randomized" classifiers where the training set class labels were randomized following sample assignment to the training or test set (shaded).
Figure 9:
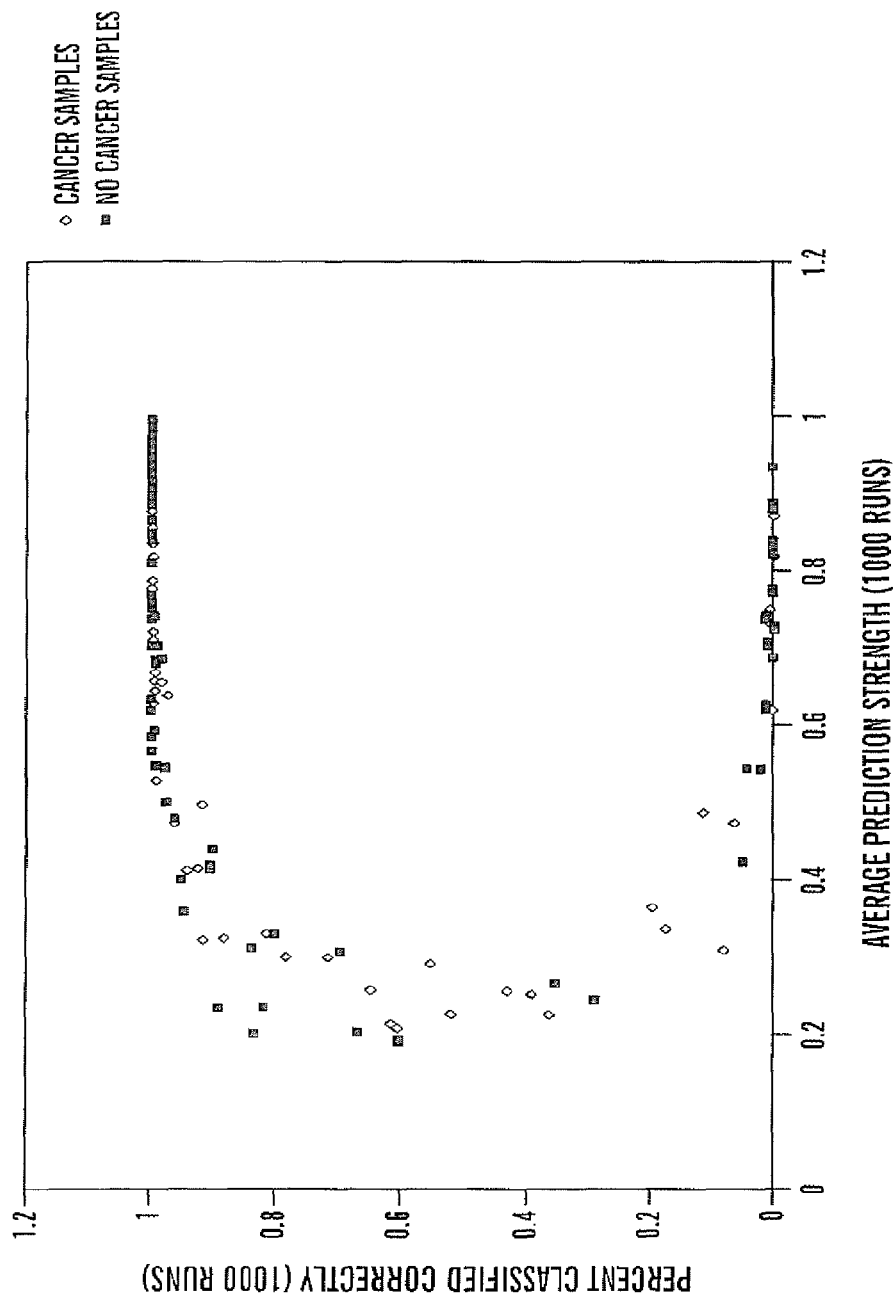
FIG. 9 shows classification accuracy as a function of the average prediction strength over the 1000 runs of the algorithm with different training/test sets.

FIG. 8 shows diagrams of the class prediction model analysis used in the Example 1.

The results of the weighted voting method for a 50 gene group analysis (50 gene committee) were as follows. Cross-validation (n=74) resulted in accuracy of 81%, with sensitivity of 76% and specificity of 85%. In an independent dataset (n=24) the accuracy was 88%, with sensitivity of 75% and specificity of 100%.

We note that with sensitivity to bronchoscopy alone only 18/45 (40%) of cancers were diagnosed at the time of bronchoscopy using brushings, washings, biopsy or Wang.

We performed a gene expression analysis of the human genome using isolated nucleic acid samples comprising lung cell transcripts from individuals. The chip used was the Human Genome U133 Set. We used Microarray Suite 5.0 software to analyze raw data from the chip (i.e. to convert the image file into numerical data). Both the chip and the software are proprietary materials from Affymetrix. Bronchoscopy was performed to obtain nucleic acid samples from 98 smoker individuals.

We performed a Student's t-test using gene expression analysis of 45 smokers with lung cancer and 53 smokers without lung cancer. We identified several groups of genes that showed significant variation in their expression between smokers with cancer and smokers without cancer. We further identified at least three groups of genes that, when their expression was analyzed in combination, the results allowed us to significantly increase diagnostic power in identifying cancer carrying smokers from smokers without cancer.

The predictor groups of genes were identified using the GenePattern server from the Broad Institute, which includes the Weighted Voting algorithm. The default settings, i.e., the signal to noise ratio and no gene filtering, were used. GenePattern is available at World Wide Web from broad.mit.edu/cancer/software/genepattern. This program allows analysis of data in groups rather than as individual genes.

Table 1 shows the top 96 genes from our analysis with different expression patterns in smokers with cancer and smokers without cancer.

Table 2 shows the 84 genes that were also identified in our previous screens as individual predictors of lung cancer.

Table 4 shows a novel group of 36 genes the expression of which was different between the smokers with cancer and smokers without cancer.

Table 3 shows a group of 50 genes that we identified as most predictive of development of cancer in smokers. That is, that when the expression of these genes was analyzed and reflected the pattern (expression down or up) as shown in Table 3, we could identify the individuals who will develop cancer based on this combined expression profile of these genes. When used in combination, the expression analysis of these 50 genes was predictive of a smoker developing lung cancer in over 70% of the samples. Accuracy of diagnosis of lung cancer in our sample was 80-85% on cross-validation and independent dataset (accuracy includes both the sensitivity and specificity). The sensitivity (percent of cancer cases correctly diagnosed) was approximately 75% as compared to sensitivity of 40% using standard bronchoscopy technique. (Specificity is percent of non-cancer cases correctly diagnosed).

These data show the dramatic increase of diagnostic power that can be reached using the expression profiling of the gene groups as identified in the present study.

Example 2

We report here a gene expression profile, derived from histologically normal large airway epithelial cells of current and former smokers with clinical suspicion of lung cancer that is highly sensitive and specific for the diagnosis of lung cancer. This airway signature is effective in diagnosing lung cancer at an early and potentially resectable stage. When combined with results from bronchoscopy (i.e. washings, brushings, and biopsies of the affected area), the expression profile is diagnostic of lung cancer in 95% of cases. We further show that the airway epithelial field of injury involves a number of genes that are differentially expressed in lung cancer tissue, providing potential information about pathways that may be involved in the genesis of lung cancer.

Patient Population: We obtained airway brushings from current and former smokers (n=208) undergoing fiber optic bronchoscopy as a diagnostic study for clinical suspicion of lung cancer between January 2003 and May 2005. Patients were recruited from 4 medical centers: Boston University Medical Center, Boston, Mass.; Boston Veterans Administration, West Roxbury, Mass.; Lahey Clinic, Burlington, Mass.; and Trinity College, Dublin, Ireland. Exclusion criteria included never smokers, cigar smokers and patients on a mechanical ventilator at the time of their bronchoscopy. Each subject was followed clinically, post-bronchoscopy, until a final diagnosis of lung cancer or an alternate benign diagnosis was made. Subjects were classified as having lung cancer if their bronchoscopy studies (brushing, bronchoalveolar lavage or endobronchial biopsy) or a subsequent lung biopsy (transthoracic biopsy or surgical lung biopsy) yielded tumor cells on pathology/cytology. Subjects were classified with an alternative benign diagnosis if the bronchoscopy or subsequent lung biopsy yielded a non-lung cancer diagnosis or if their radiographic abnormality resolved on follow up chest imaging. The study was approved by the Institutional Review Boards of all 4 medical centers and all participants provided written informed consent.

Airway epithelial cell collection: Following completion of the standard diagnostic bronchoscopy studies, bronchial airway epithelial cells were obtained from the "uninvolved" right mainstem bronchus with an endoscopic cytobrush (Cellebrity Endoscopic Cytobrush, Boston Scientific, Boston, Mass.). If a suspicious lesion (endobronchial or submucosal) was seen in the right mainstem bronchus, cells were then obtained from the uninvolved left mainstem bronchus. The brushes were immediately placed in TRIzol reagent (Invitrogen, Carlsbad, Calif.) after removal from the bronchoscope and kept at −80° C. until RNA isolation was performed. RNA was extracted from the brushes using TRIzol Reagent (Invitrogen) as per the manufacturer protocol, with a yield of 8-15 μg of RNA per patient. Integrity of the RNA was confirmed by denaturing gel electrophoresis. Epithelial cell content and morphology of representative bronchial brushing samples was quantified by cytocentrifugation (ThermoShandon Cytospin, Pittsburgh, Pa.) of the cell pellet and staining with a cytokeratin antibody (Signet, Dedham Mass.). These samples were reviewed by a pathologist who was blinded to the diagnosis of the patient.

Microarray data acquisition and preprocessing: 6-8 μg of total RNA was processed, labeled, and hybridized to Affymetrix HG-U133A GeneChips containing approximately 22,215 human transcripts as described previously (17). We obtained sufficient quantity of high quality RNA for microarray studies from 152 of the 208 samples. The quantity of RNA obtained improved during the course of the study so that 90% of brushings yielded sufficient high quality RNA during the latter half of the study. Log-normalized probe-level data was obtained from CEL files using the Robust Multichip Average (RMA) algorithm(18). A z-score filter was employed to filter out arrays of poor quality (see supplement for details), leaving 129 samples with a final diagnosis available for analysis.

Microarray Data Analysis: Class Prediction

To develop and test a gene expression predictor capable of distinguishing smokers with and without lung cancer, 60% of samples (n=77) representing a spectrum of clinical risk for lung cancer and approximately equal numbers of cancer and no cancer subjects were randomly assigned to a training set (see Supplement). Using the training set samples, the 22,215 probesets were filtered via ANCOVA using packyears as the covariate; probesets with a p-value greater than 0.05 for the difference between the two groups were excluded. This training-set gene filter was employed to control for the potential confounding effect of cumulative tobacco exposure, which differed between subjects with and without cancer (see Table 1a).

|  | Cancer | NonCancer |
|---|---|---|
| Samples | 60 | 69 |
| Age ** | 64.1 +/− 9.0 | 49.8 +/− 15.2 |
| Smoking Status | 51.7% F, 48.3% C | 37.7% F, 62.3% C |
| Gender | 80% M, 20% F | 73.9% M, 26.1% F |
| PackYears ** | 57.4 +/− 25..6 | 29.4 +/− 27..3 |
| Age Started | 15.2 +/− 4.2 | 16.7 +/− 6.8 |
| Smoking intensity (PPD): Currents * | 1.3 +/− 0.45 | 0.9 +/− 0.5 |
| Months Quit: Formers | 113 +/− 118 | 158 +/− 159 |

* Two classes statistically different: p < 0.05
** Two classes statistically different: p < 0.001

Table 1a shows demographic features and characteristics of the two patient classes being studied. Statistical differences between the two patient classes and associated p values were calculated using T-tests, Chi-square tests and Fisher's exact tests where appropriate.

Gene selection was conducted through internal cross-validation within the training set using the weighted voting algorithm(19). The internal cross-validation was repeated 50 times, and the top 40 up- and top 40 down-regulated probesets in cancer most frequently chosen during internal cross-validation runs were selected as the final gene committee of 80 features (see sections, infra, for details regarding the algorithm and the number of genes selected for the committee).

The accuracy, sensitivity, and specificity of the biomarker were assessed on the independent test set of 52 samples. This was accomplished by using the weighted vote algorithm to predict the class of each test set sample based on the gene expression of the 80 probesets and the probe set weights derived from the 77 samples in the training set. To assess the performance of our classifier, we first created 1000 predictors from the training set where we randomized the training set class labels. We evaluated the performance of these "class-randomized" classifiers for predicting the sample class of the test set samples and compared these to our classifier using ROC analysis. To assess whether the performance of our gene expression profile depends on the specific training and test sets from which it was derived and tested, we next created 500 new training and test sets with our 129 samples and derived new "sample-randomized" classifiers from each of these training sets which were then tested on the corresponding test set. To assess the specificity of our classifier genes, we next created 500 classifiers each composed of 80 randomly selected genes. We then tested the ability of these "gene-randomized" classifiers to predict the class of samples in the test set. To evaluate the robustness of our class prediction algorithm and data preprocessing, we also used these specific 80 genes to generate predictive models with an alternate class prediction algorithm (Prediction Analysis of Microarrays (PAM)(20)) and with MAS 5.0 generated expression data instead of RMA. Finally, the performance of our predictor was compared to the diagnostic yield of bronchoscopy.

Quantitative PCR Validation: Real time PCR (QRT-PCR) was used to confirm the differential expression of a select number of genes in our predictor. Primer sequences were designed with Primer Express software (Applied Biosystems, Foster City, Calif.). Forty cycles of amplification, data acquisition, and data analysis were carried out in an ABI Prism 7700 Sequence Detector (Applied Biosystems, Foster City, Calif.). All real time PCR experiments were carried out in triplicate on each sample (see sections infra).

Linking to lung cancer tissue microarray data: The 80-gene lung cancer biomarker derived from airway epithelium gene expression was evaluated for its ability to distinguish between normal and cancerous lung tissue using an Affymetrix HGU95Av2 dataset published by Bhattacharjee et al(21) that we processed using RMA. By mapping Unigene identifiers, 64 HGU95Av2 probesets were identified that measure the expression of genes that corresponded to the 80 probesets in our airway classifier. This resulted in a partial airway epithelium signature that was then used to classify tumor and normal samples from the dataset. In addition, PCA analysis of the lung tissue samples was performed using the expression of these 64 probesets.

To further assess the statistical significance of the relationship between datasets, Gene Set Enrichment Analysis (22) was performed to determine if the 64 biomarker genes are non-randomly distributed within the HGU95Av2 probesets ordered by differential expression between normal and tumor tissue. Finally, a two-tailed Fisher Exact Test was used to test if the proportion of biomarker genes among the genes differentially expressed between normal and tumor lung tissue is different from the overall proportion of differentially expressed genes (see sections, infra).

Statistical Analysis: RMA was performed in BioConductor. The upstream gene filtering by ANCOVA, and the implementation of the weighted voted algorithm and internal cross validation used to generate the data were executed through an R script we wrote for this purpose. The PAM algorithm was carried out using the 'pamr' library in R. All other statistical analyses including Student's T-Tests, Fisher's exact tests, ROC curves and PCA were performed using the R statistical package.

Study Population and Epithelial samples: 129 subjects that had microarrays passing the quality control filter described above were included in the class prediction analysis (see Supplemental FIG. 1). Demographic data on these subjects, including 60 smokers with primary lung cancer and 69 smokers without lung cancer is presented in Table 1, Cell type and stage information for all cancer patients is shown in Supplemental Table 1, Bronchial brushings yielded 90% epithelial cells, as determined by cytokeratin staining, with the majority being ciliated cells with normal bronchial airway morphology. No dysplastic or cancer cells were seen on any representative brushings obtained from smokers with or without cancer.

Figure 14:
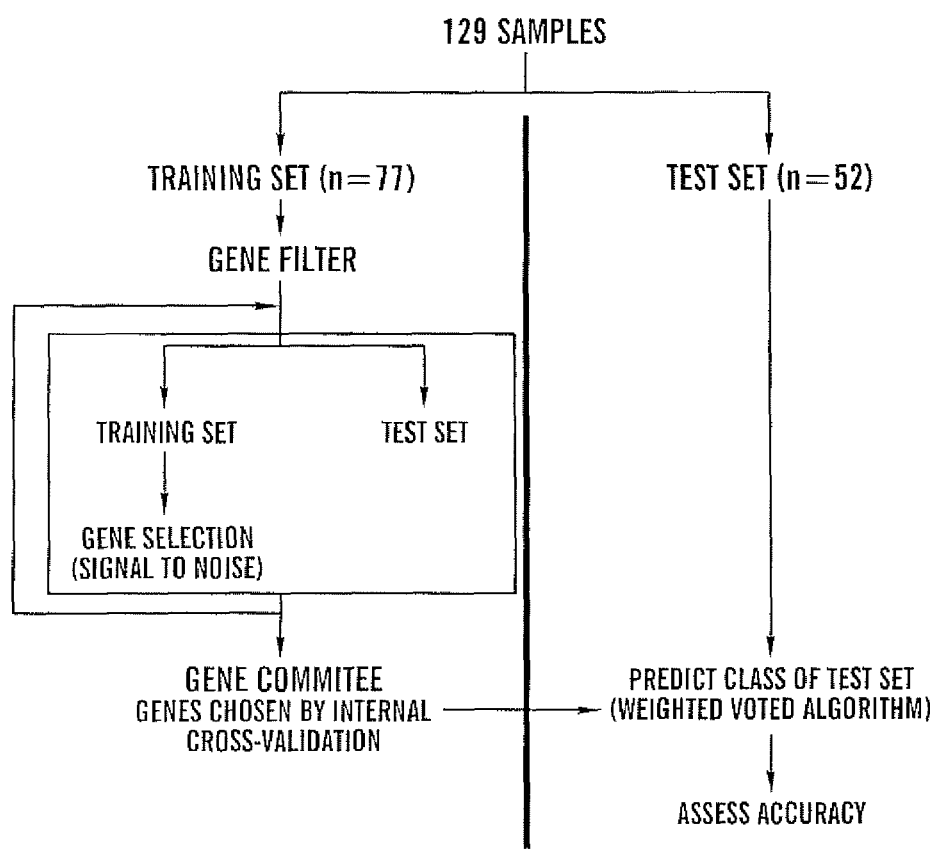
FIG. 14 shows the class prediction methodology used. 129 samples (69 from patients without cancer; 60 from patients with lung cancer) were separated into a training (n=77) and a test set (n=52). The most frequently chosen 40 up- and 40 down-regulated genes from internal cross validation on the training set were selected for the final gene committee. The weighted voted algorithm using this committee of 80 genes was then used to predict the class of the test set samples.
Figure 15:
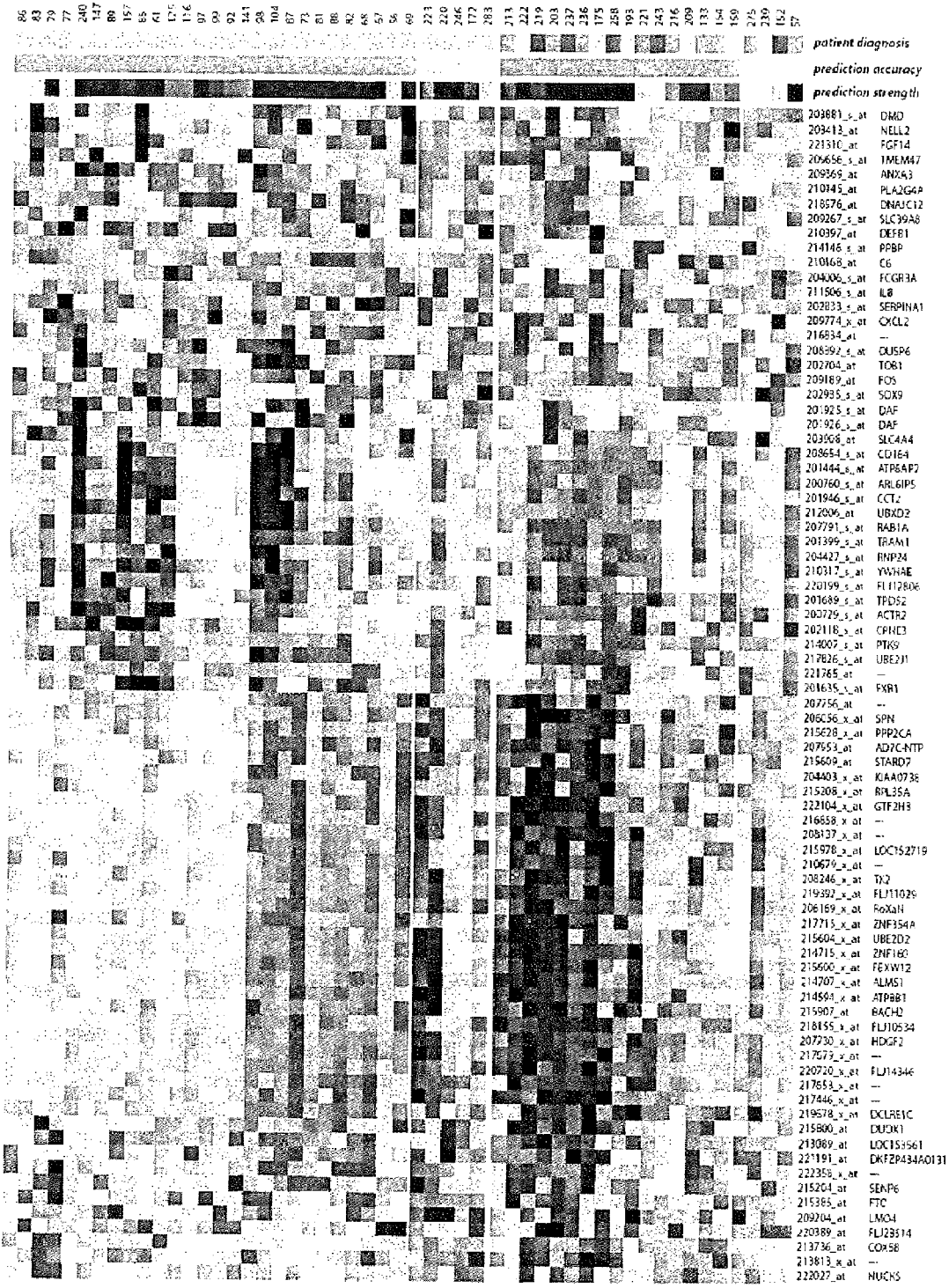
FIG. 15 shows hierarchical clustering of class-predictor genes. Z-score-normalized gene-expression measurements of the eighty class-predictor genes in the 52 test-set samples are shown in a false-color scale and organized from top to bottom by hierarchical clustering. The Affymetrix U133A probeset ID and HUGO symbol are given to the right of each gene. The test-set samples are organized from left to right first by whether the patient had a clinical diagnosis of cancer. Within these two groups, the samples are organized by the accuracy of the class-predictor diagnosis (samples classified incorrectly are on the right shown in dark green). 43/52 (83%) test samples are classified correctly. The sample ID is given at the top of each column. The prediction strength of each of the diagnoses made by the class-prediction algorithm is indicated in a false-color scale immediately below the prediction accuracy. Prediction strength is a measure of the level of diagnostic confidence and varies on a continuous scale from 0 to 1 where 1 indicates a high degree of confidence.
Figure 15:
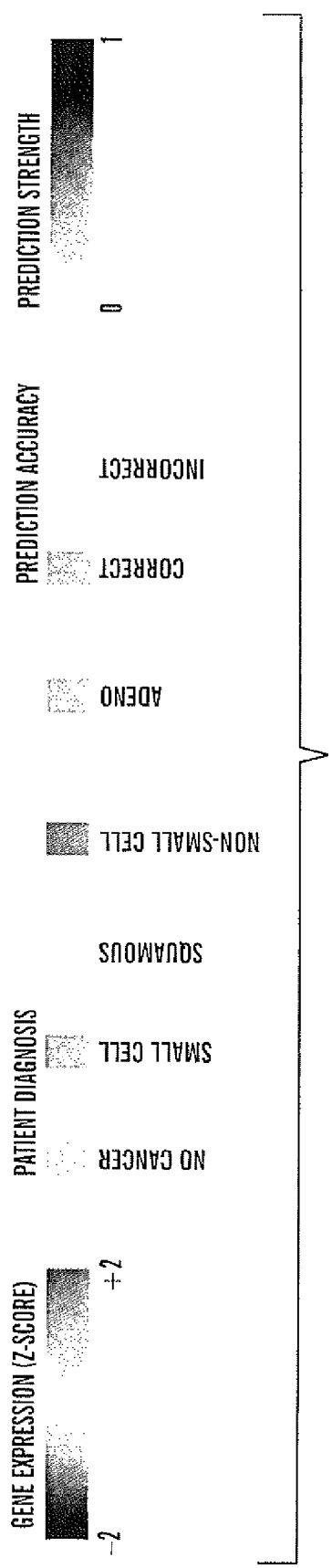

Class Prediction analysis: Comparison of demographic features for 77 subjects in the training set vs. the 52 samples in the test set is shown in Supplemental Table 2. An 80 gene class prediction committee capable of distinguishing smokers with and without cancer was built on the training set of 77 samples and tested on the independent sample set (FIG. 14). The accuracy, sensitivity and specificity of this model was 83%(43/52), 80% (16/20) and 84% (27/32) respectively. When samples predicted with a low degree of confidence (as defined by a Prediction Strength metric <0.3; see Supplement for details) were considered non-diagnostic, the overall accuracy of the model on the remaining 43 samples in the test set increased to 88% (93% sensitivity, 86% specificity). Hierarchical clustering of the 80 genes selected for the diagnostic biomarker in the test set samples is shown in FIG. 15. Principal Component Analysis of all cancer samples according to the expression of these 80 genes did not reveal grouping by cell type (FIG. 10). The accuracy of this 80-gene classifier was similar when microarray data was preprocessed in MAS 5.0 and when the PAM class prediction algorithm was used (see Supplemental Table 3).

Figure 11:
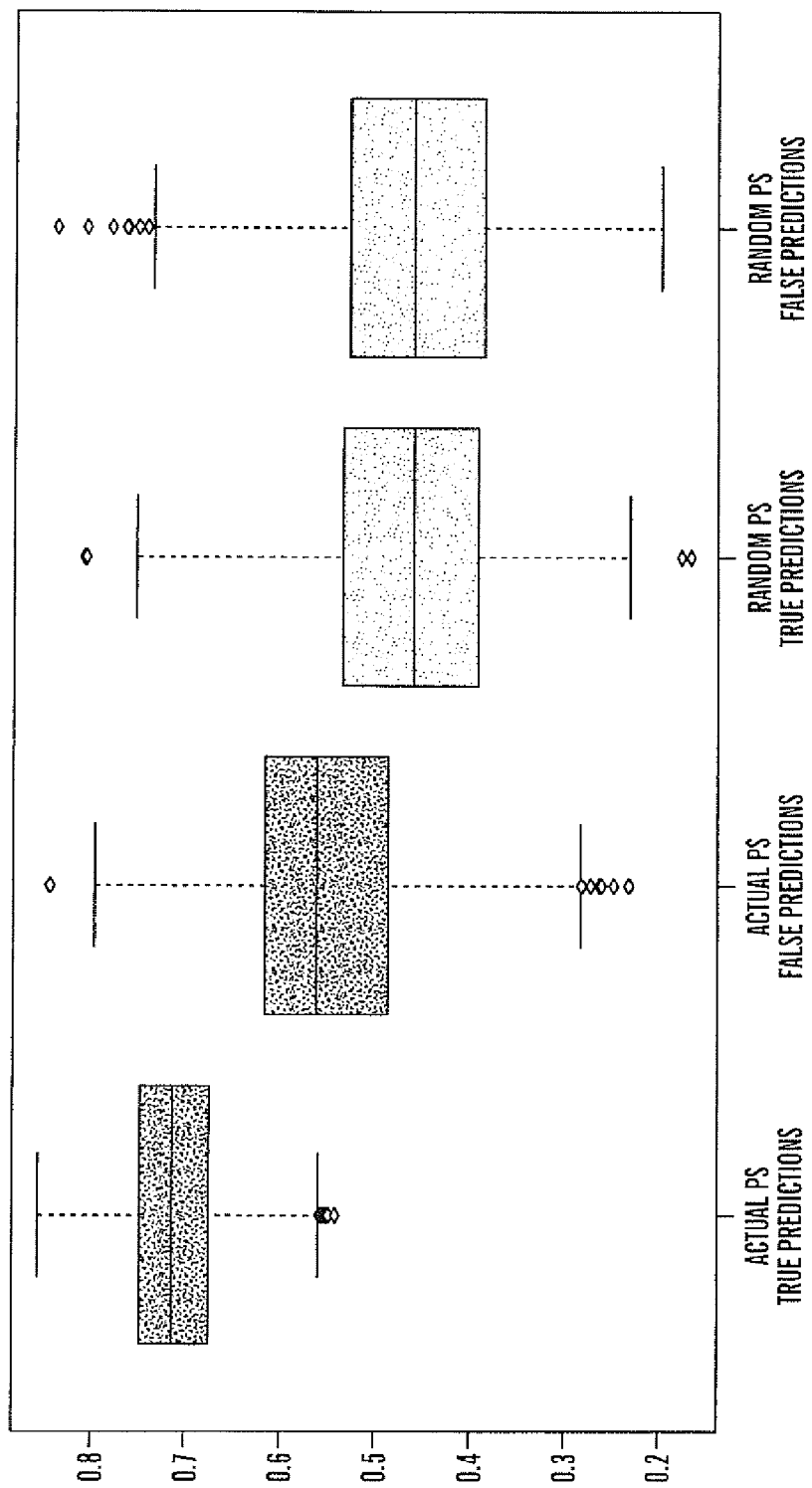
FIG. 11 shows Boxplot of the Prediction Strength values of the test set sample predictions made by the Weighted Voting algorithm across the 1000 runs with different training and test sets. The black boxplots (first two boxes from the left) are derived from the actual training and test set data with correct sample labels, the grey boxplots (last two boxes on the right) are derived from the test set predictions based on training sets with randomized sample labels.
Figure 16:
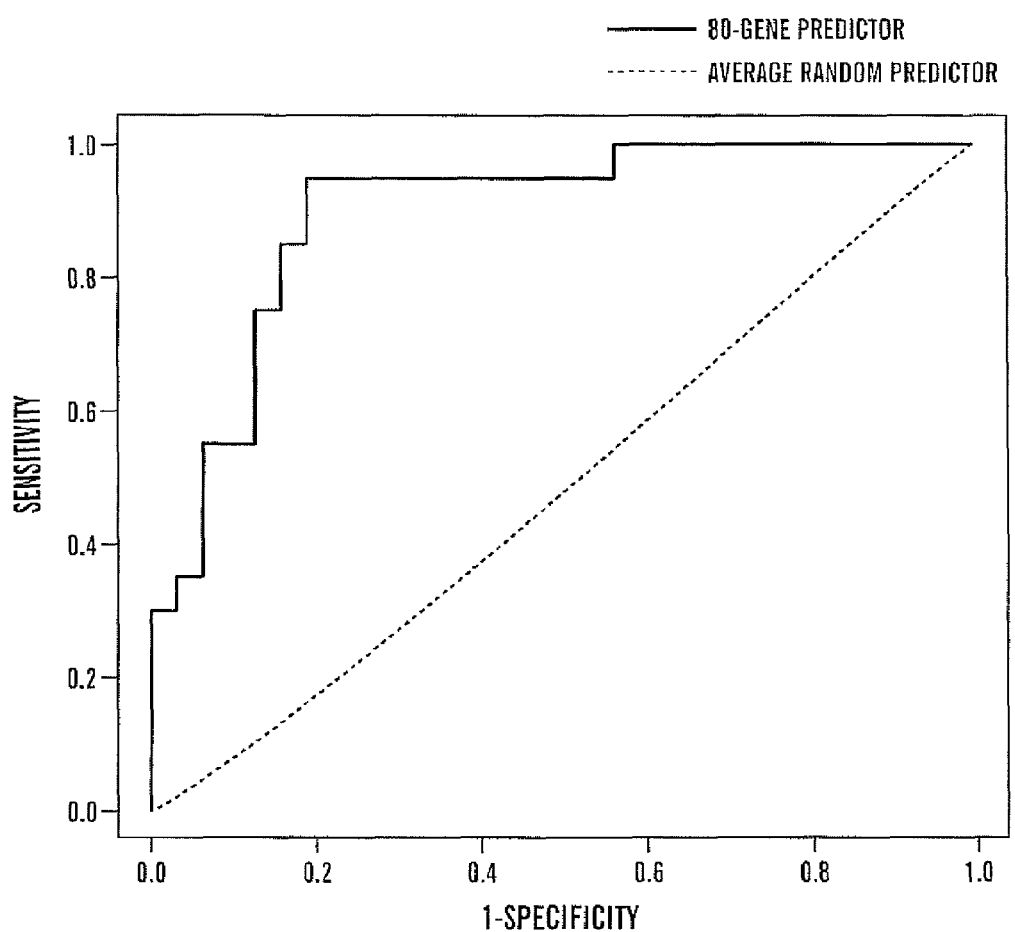
FIG. 16 shows a Comparison of Receiver Operating Characteristic (ROC) curves. Sensitivity (y-axis) and 1-Specificity (x-axis) were calculated at various prediction strength thresholds where a prediction of no cancer was assigned a negative prediction strength value and a prediction of cancer was assigned a positive prediction strength value. The solid black line represents the ROC curve for the airway gene expression classifier. The dotted black line represents the average ROC curve for 1000 classifiers derived by randomizing the training set class labels ("class randomized"). The upper and lower lines of the gray shaded region represent the average ROC curves for the top and bottom half of random biomarkers (based on area under the curve). There is a significant difference between the area under the curve of the actual classifier and the random classifiers (p=0.004; empiric p-value based on permutation)

The 80-gene predictor's accuracy, sensitivity and specificity on the 52 sample test set was significantly better than the performance of classifiers derived from randomizing the class labels of the training set (p=0.004; empiric p-value for random classifier AUC>true classifier AUC; FIG. 16). The performance of the classifier was not dependent on the particular composition of the training and test set on which it was derived and tested: 500 training and test sets (derived from the 129 samples) resulted in classifiers with similar accuracy as the classifier derived from our training set (FIG. 11). Finally, we demonstrated that the classifier is better able to distinguish the two sample classes than 500 classifiers derived by randomly selecting genes (see FIG. 12).

Real time PCR: Differential expression of select genes in our diagnostic airway profile was confirmed by real time PCR (see FIG. 13).

Figure 17:
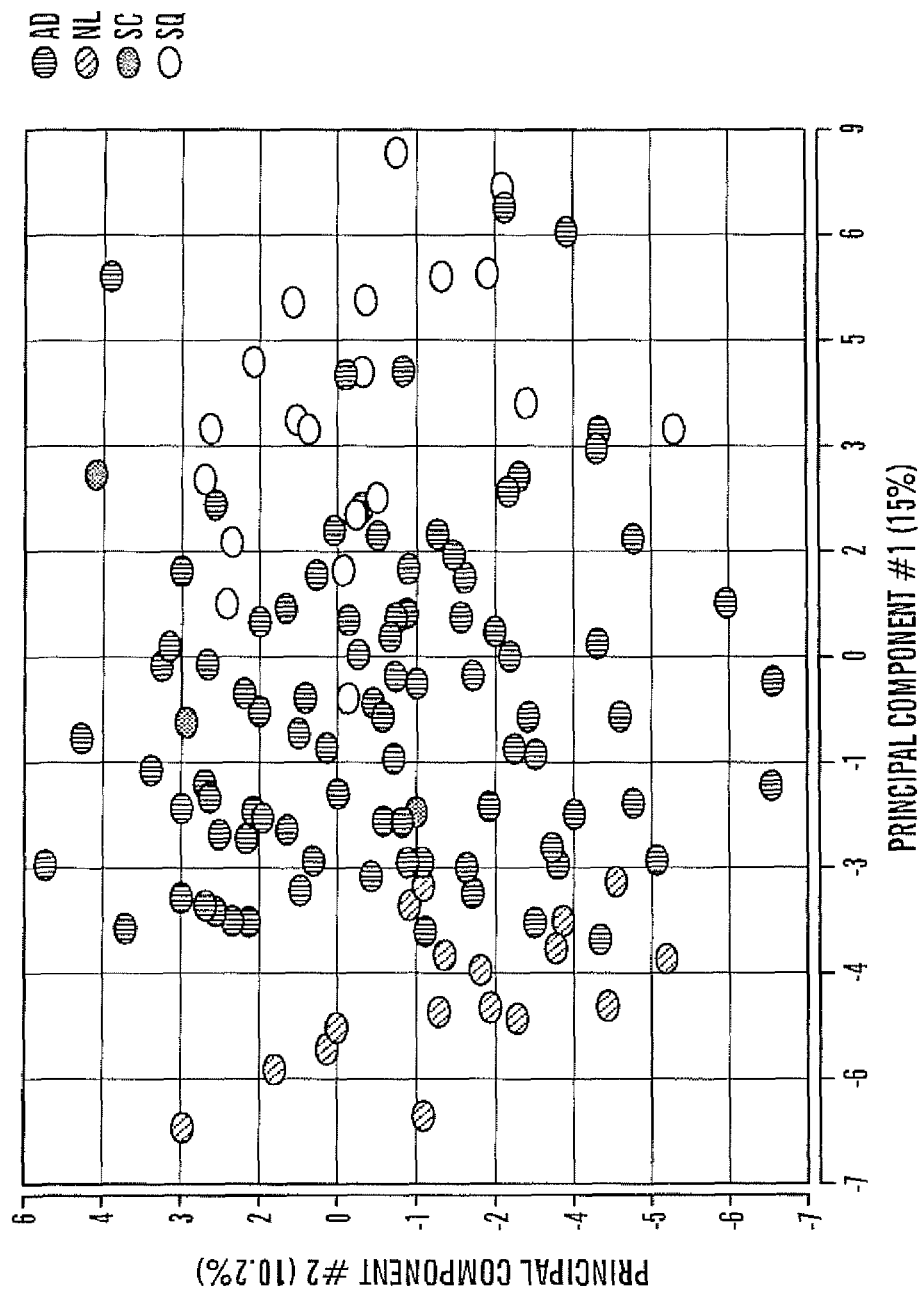
FIG. 17 shows the Principal Component Analysis (PCA) of biomarker gene expression in lung tissue samples. The 80 biomarker probesets were mapped to 64 probesets in the Bhattacharjee et al. HGU95Av2 microarray dataset of lung cancer and normal lung tissue. The PCA is a representation of the overall variation in expression of the 64 biomarker probesets. The normal lung samples (NL) are represented in green, the adenocarcinomas (AD) in red, the small cells (SC) in blue, and the squamous (SQ) lung cancer samples in yellow. The normal lung samples separate from the lung cancer samples along the first principal component (empirically derived p-value=0.023, see supplemental methods).

Linking to lung cancer tissue: Our airway biomarker was also able to correctly classify lung cancer tissue from normal lung tissue with 98% accuracy. Principal Component Analysis demonstrated separation of non-cancerous samples from cancerous samples in the Bhattacharjee dataset according to the expression of our airway signature (see FIG. 17). Furthermore, our class prediction genes were statistically over represented among genes differentially expressed between cancer vs. no cancer in the Bhattacharjee dataset by Fisher exact test (p<0.05) and Gene Enrichment Analysis (FDR<0.25, see Supplement for details).

Figure 18A:
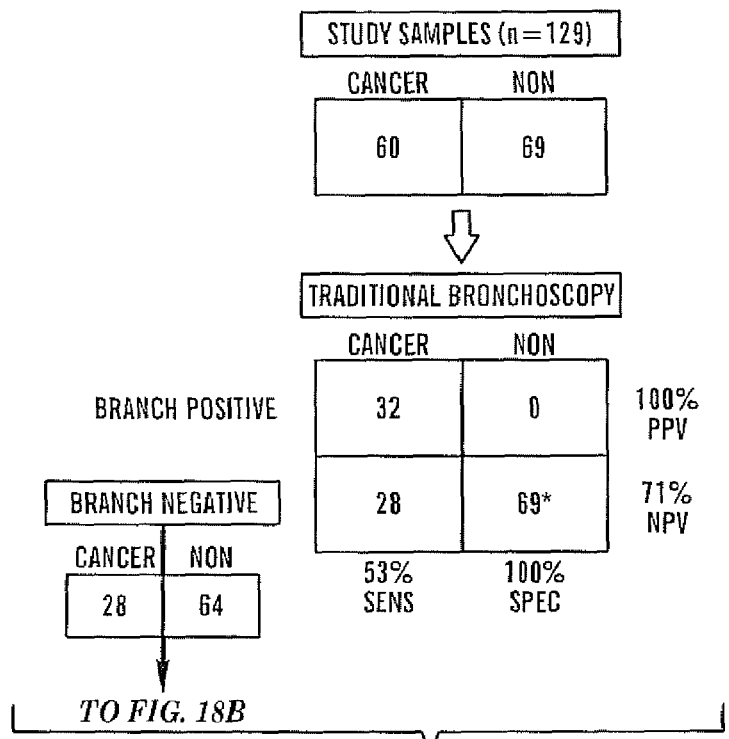
FIGS. 18A-18C show data obtained in this study.
Figure 18B:
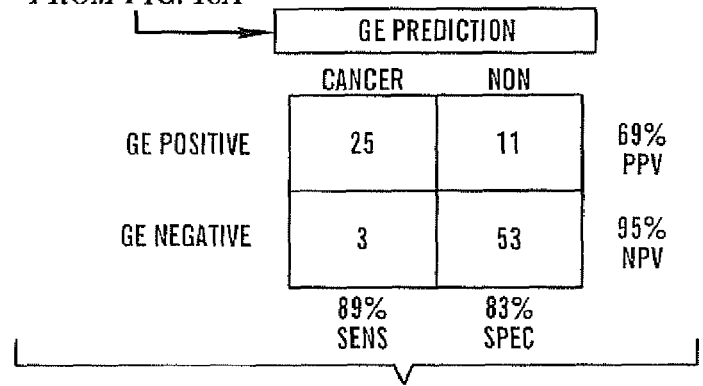
Figure 18C:
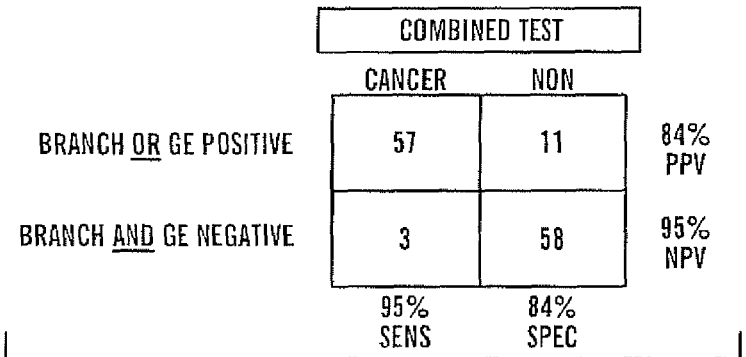

Synergy with Bronchoscopy: Bronchoscopy was diagnostic (via endoscopic brushing, washings or biopsy of the affected region) in 32/60 (53%) of lung cancer patients and 5/69 non-cancer patients. Among non-diagnostic bronchoscopies (n=92), our class prediction model had an accuracy of 85% with 89% sensitivity and 83% specificity. Combining bronchoscopy with our gene expression signature resulted in a 95% diagnostic sensitivity (57/60) across all cancer subjects. Given the approximate 50% disease prevalence in our cohort, a negative bronchoscopy and negative gene expression signature for lung cancer resulted in a 95% negative predictive value (NPV) for disease (FIG. 18). In patients with a negative bronchoscopy, the positive predictive value of our gene expression profile for lung cancer was approximately 70% (FIG. 18).

Figure 19A:
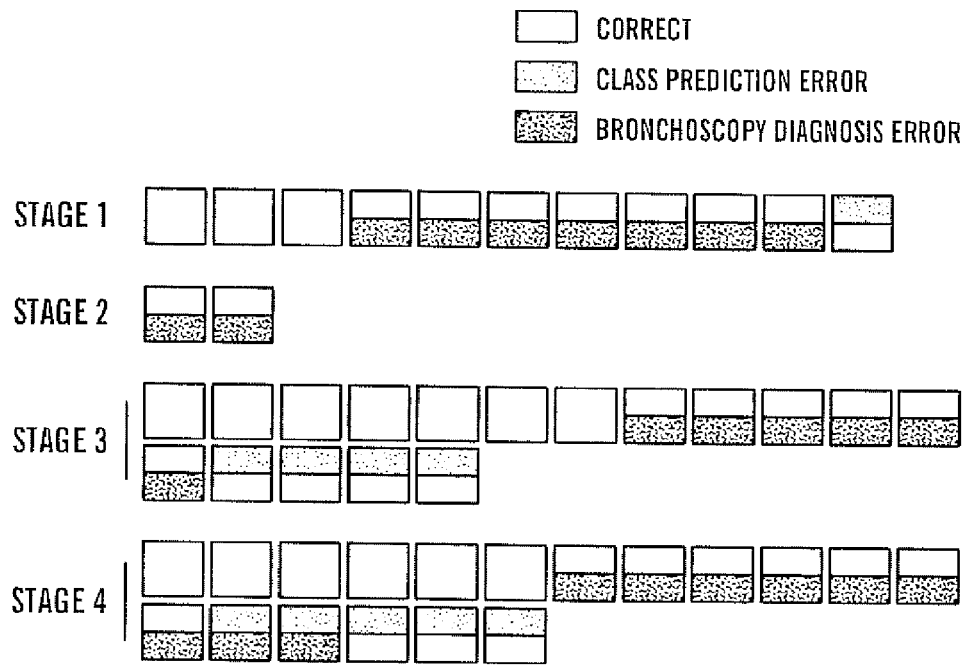
FIGS. 19A-19B show a comparison of bronchoscopy and biomarker prediction by A) cancer stage or B) cancer subtype. Each square symbolizes one patient sample. The upper half represents the biomarker prediction accuracy and the lower half represents the bronchoscopy accuracy. Not all cancer samples are represented in this figure.
Figure 19B:
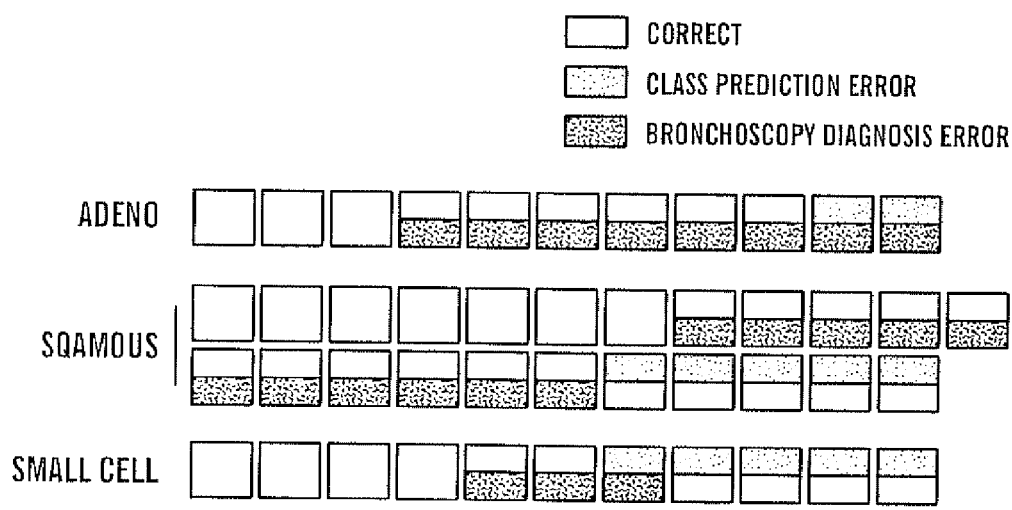

Stage and cell type subgroup analysis: The diagnostic yield of our airway gene expression signature vs. bronchoscopy according to stage and cell type of the lung cancer samples is shown in FIG. 19.

Lung cancer is the leading cause of death from cancer in the United States, in part because of the lack of sensitive and specific diagnostic tools that are useful in early-stage disease. With approximately 90 million former and current smokers in the U.S., physicians increasingly encounter smokers with clinical suspicion for lung cancer on the basis of an abnormal radiographic imaging study and/or respiratory symptoms. Flexible bronchoscopy represents a relatively noninvasive initial diagnostic test to employ in this setting. This study was undertaken in order to develop a gene expression-based diagnostic, that when combined with flexible bronchoscopy, would provide a sensitive and specific one-step procedure for the diagnosis of lung cancer. Based on the concept that cigarette smoking creates a respiratory tract "field defect", we examined the possibility that profiles of gene expression in relatively easily accessible large airway epithelial cells would serve as an indicator of the amount and type of cellular injury induced by smoking and might provide a diagnostic tool in smokers who were being evaluated for the possibility of lung cancer.

We have previously shown that smoking induces a number of metabolizing and antioxidant genes, induces expression of several putative oncogenes and suppresses expression of several potential tumor suppressor genes in large airway epithelial cells(17). We show here that the pattern of airway gene expression in smokers with lung cancer differs from smokers without lung cancer, and the expression profile of these genes in histologically normal bronchial epithelial cells can be used as a sensitive and specific predictor of the presence of lung cancer. We found that the expression signature was particularly useful in early stage disease where bronchoscopy was most often negative and where most problems with diagnosis occur. Furthermore, combining the airway gene expression signature with bronchoscopy results in a highly sensitive diagnostic approach capable of identifying 95% of lung cancer cases.

Given the unique challenges to developing biomarkers for disease using DNA microarrays(23), we employed a rigorous computational approach in the evaluation of our dataset. The gene expression biomarker reported in this paper was derived from a training set of samples obtained from smokers with suspicion of lung cancer and was tested on an independent set of samples obtained from four tertiary medical centers in the US and Ireland. The robust nature of this approach was confirmed by randomly assigning samples into separate training and test sets and demonstrating a similar overall accuracy (FIG. 11). In addition, the performance of our biomarker was significantly better than biomarkers obtained via randomization of class labels in the training set (FIG. 16) or via random 80 gene committees (FIG. 8). Finally, the performance of our 80-gene profile remained unchanged when microarray data was preprocessed via a different algorithm or when a second class prediction algorithm was employed.

In terms of limitations, our study was not designed to assess performance as a function of disease stage or subtype. Our gene expression predictor, however, does appear robust in early stage disease compared with bronchoscopy (see FIG. 19). Our profile was able to discriminate between cancer and no cancer across all subtypes of lung cancer (see FIG. 10). 80% of the cancers in our dataset were NSCLC and our biomarker was thus trained primarily on events associated with that cell type. However, given the high yield for bronchoscopy alone in the diagnosis of small cell lung cancer, this does not limit the sensitivity and negative predictive value of the combined bronchoscopy and gene expression signature approach. A large-scale clinical trial is needed to validate our signature across larger numbers of patients and establish its efficacy in early stage disease as well as its ability to discriminate between subtypes of lung cancer.

In addition to serving as a diagnostic biomarker, profiling airway gene expression across smokers with and without lung cancer can also provide insight into the nature of the "field of injury" reported in smokers and potential pathways implicated in lung carcinogenesis. Previous studies have demonstrated allelic loss and methylation of tumor suppressor genes in histologically normal bronchial epithelial cells from smokers with and without lung cancer(12;13;15). Whether these changes are random mutational effects or are directly related to lung cancer has been unclear. The finding that our airway gene signature was capable of distinguishing lung cancer tissue from normal lung (FIG. 4) suggests that the airway biomarker is, at least in part, reflective of changes occurring in the cancerous tissue and may provide insights into lung cancer biology.

Among the 80 genes in our diagnostic signature, a number of genes associated with the RAS oncogene pathway, including Rab 1a and FOS, are up regulated in the airway of smokers with lung cancer. Rab proteins represent a family of at least 60 different Ras-like GTPases that have crucial roles in vesicle trafficking, signal transduction, and receptor recycling, and dysregulation of RAB gene expression has been implicated in tumorigenesis(24). A recent study by Shimada et al.(25) found a high prevalence of Rab1A-overexpression in head and neck squamous cell carcinomas and also in premalignant tongue lesions, suggesting that it may be an early marker of smoking-related respiratory tract carcinogenesis.

In addition to these RAS pathway genes, the classifier contained several pro-inflammatory genes, including Interleukin-8 (IL-8) and beta-defensin 1 that were up regulated in smokers with lung cancer. IL-8, originally discovered as a chemotactic factor for leukocytes, has been shown to contribute to human cancer progression through its mitogenic and angiogenic properties(26;27). Beta defensins, antimicrobial agents expressed in lung epithelial cells, have recently found to be elevated in the serum of patients with lung cancer as compared to healthy smokers or patients with pneumonia(28). Higher levels of these mediators of chronic inflammation in response to tobacco exposure may result in increased oxidative stress and contribute to tumor promotion and progression in the lung(29;30)

A number of key antioxidant defense genes were found to be decreased in airway epithelial cells of subjects with lung cancer, including BACH2 and dual oxidase 1, along with a DNA repair enzyme, DNA repair protein 1C. BACH-2, a transcription factor, promotes cell apoptosis in response to high levels of oxidative-stress(31). We have previously found that a subset of healthy smokers respond differently to tobacco smoke, failing to induce a set of detoxification enzymes in their normal airway epithelium, and that these individuals may be predisposed to its carcinogenic effects (17). Taken together, these data suggest that a component of the airway "field defect" may reflect whether a given smoker is appropriately increasing expression of protective genes in response to the toxin. This inappropriate response may reflect a genetic susceptibility to lung cancer or alternatively, epigenetic silencing or deletion of that gene by the carcinogen.

In summary, our study has identified an airway gene expression biomarker that has the potential to directly impact the diagnostic evaluation of smokers with suspect lung cancer. These patients usually undergo fiberoptic bronchoscopy as their initial diagnostic test. Gene expression profiling can be performed on normal-appearing airway epithelial cells obtained in a simple, noninvasive fashion at the time of the bronchoscopy, prolonging the procedure by only 3-5 minutes, without adding significant risks. Our data strongly suggests that combining results from bronchoscopy with the gene expression biomarker substantially improves the diagnostic sensitivity for lung cancer (from 53% to 95%). In a setting of 50% disease prevalence, a negative bronchoscopy and negative gene expression signature for lung cancer results in a 95% negative predictive value (NPV), allowing these patients to be followed non-aggressively with repeat imaging studies. For patients with a negative bronchoscopy and positive gene expression signature, the positive predictive value is ~70%, and these patients would likely require further invasive testing (i.e.

transthoracic needle biopsy or open lung biopsy) to confirm the presumptive lung cancer diagnosis. However, this represents a substantial reduction in the numbers of patients requiring further invasive diagnostic testing compared to using bronchoscopy alone. In our study, 92/129 patients were bronchoscopy negative and would have required further diagnostic work up. However, the negative predictive gene expression profile in 56 of these 92 negative bronchoscopy subjects would leave only 36 subjects who would require further evaluation (see FIG. 18).

The cross-sectional design of our study limits interpretation of the false positive rate for our signature. Given that the field of injury may represent whether a smoker is appropriately responding to the toxin, derangements in gene expression could precede the development of lung cancer or indicate a predisposition to the disease. Long-term follow-up of the false positive cases is needed (via longitudinal study) to assess whether they represent smokers who are at higher risk for developing lung cancer in the future. If this proves to be true, our signature could serve as a screening tool for lung cancer among healthy smokers and have the potential to identify candidates for chemoprophylaxis trials.

Study Patients and Sample Collection

A. Primary sample set We recruited current and former smokers undergoing flexible bronchoscopy for clinical suspicion of lung cancer at four tertiary medical centers. All subjects were older than 21 years of age and had no contraindications to flexible bronchoscopy including hemodynamic instability, severe obstructive airway disease, unstable cardiac or pulmonary disease (i.e. unstable angina, congestive heart failure, respiratory failure) inability to protect airway or altered level of consciousness and inability to provide informed consent. Never smokers and subjects who only smoked cigars were excluded from the study. For each consented subject, we collected data regarding their age, gender, race, and a detailed smoking history including age started, age quit, and cumulative tobacco exposure. Former smokers were defined as patients who had not smoked a cigarette for at least one month prior to entering our study. All subjects were followed, post-bronchoscopy, until a final diagnosis of lung cancer or an alternative diagnosis was made (mean follow-up time=52 days). For those patients diagnosed with lung cancer, the stage and cell type of their tumor was recorded. The clinical data collected from each subject in this study can be accessed in a relational database at http://pulm.bumc.bu.edu/CancerDx/. The stage and cell type of the 60 cancer samples used to train and test the class prediction model is shown in Supplemental Table 1 below.

| Cell Type | | Stage NSCLC staging | |
|---|---|---|---|
| NSCLC | 48 | IA | 2 |
| Squamous Cell | 23 | IB | 9 |
| Adenocarcinoma | 11 | IIA | 2 |
| Large Cell | 4 | IIB | 0 |
| Not classified | 10 | IIIA | 9 |
| Small Cell | 11 | IIIB | 9 |
| Unknown | 1 | IV | 17 |

Supplemental Table 1 above shows cell type and staging information for 60 lung cancer patients in the 129 primary sample set used to build and test the class prediction model. Staging information limited to the 48 non-small cell samples.

The demographic features of the samples in training and test shown are shown in Supplemental Table 2 below. The Table shows patient demographics for the primary dataset (n=129) according to training and test set status. Statistical differences between the two patient classes and associated p values were calculated using T-tests, Chi-square tests and Fisher's exact tests where appropriate. PPD=packs per day, F=former smokers, C=current smokers, M=male, F=female.

| | Training set | Test set |
|---|---|---|
| Samples | 77 | 52 |
| Age | 59.3 +/− 13.1 | 52.1 +/− 15.6 |
| Smoking Status | 41.6% F, 58.4% C | 48.1% F, 51.9% C |
| Gender* | 83.1% M, 16.9% F | 67.3% N, 32.7% F |
| PackYears | 45.6 +/− 31 | 37.7 +/− 27.8 |
| Age Started | 16.2 +/− 6.3 | 15.8 +/− 5.3 |
| Smoking intensity (PPD): Currents | 1.1 +/− 0.53 | 1 +/− 0.5 |
| Months Quit: Formers | 128 +/− 139 | 139 +/− 141 |

*Two classes statistically different: p < 0.05

While our study recruited patients whose indication for bronchoscopy included a suspicion for lung cancer, each patient's clinical pre-test probability for disease varied. In order to ensure that our class prediction model was trained on samples representing a spectrum of lung cancer risk, three independent pulmonary clinicians, blinded to the final diagnoses, evaluated each patient's clinical history (including age, smoking status, cumulative tobacco exposure, co-morbidities, symptoms/signs and radiographic findings) and assigned a pre-bronchoscopy probability for lung cancer. Each patient was classified into one of three risk groups: low (<10% probability of lung cancer), medium (10-50% probability of lung cancer) and high (>50% probability of lung cancer). The final risk assignment for each patient was decided by the majority opinion.

Prospective Sample Set:

After completion of the primary study, a second set of samples was collected from smokers undergoing flexible bronchoscopy for clinical suspicion of lung cancer at 5 medical centers (St. Elizabeth's Hospital in Boston, Mass. was added to the 4 institutions used for the primary dataset). Inclusion and exclusion criteria were identical to the primary sample set. Forty additional subjects were included in this second validation set. Thirty-five subjects had microarrays that passed our quality-control filter. Demographic data on these subjects, including 18 smokers with primary lung cancer and 17 smokers without lung cancer, is presented in Supplemental Table 3. There was no statistical difference in age or cumulative tobacco exposure between case and controls in this prospective cohort (as opposed to the primary dataset; see Table 1a).

Supplemental Table 3 below shows patient demographics for the prospective validation set (n=35) by cancer status. Statistical differences between the two patient classes and associated p values were calculated using T-tests, Chi-square tests and Fisher's exact tests where appropriate. PPD=packs per day, F=former smokers, C=current smokers, M=male, F=female.

| | Cancer | No Cancer |
|---|---|---|
| Samples | 18 | 17 |
| Age | 66.1 +/− 11.4 | 62.2 +/− 11.1 |
| Smoking Status | 66.7 F, 33.3% C | 52.9% F, 47.1% C |

|  | Cancer | No Cancer |
|---|---|---|
| Gender* | 66.6% M, 33.3% F | 70.6% M, 29.4% F |
| PackYears | 46.7 +/− 28.8 | 60 +/− 44.3 |
| Age Started | 16.4 +/− 7.3 | 14.2 +/− 3.8 |
| Smoking intensity (PPD): Currents | 1.1 +/− 0.44 | 1.2 +/− 0.9 |
| Months Quit: Formers | 153 +/− 135 | 93 +/− 147 |

*Two classes statistically different: $p < 0.05$

Airway Epithelial Cell Collection:

Bronchial airway epithelial cells were obtained from the subjects described above via flexible bronchoscopy. Following local anesthesia with 2% topical lidocaine to the oropharynx, flexible bronchoscopy was performed via the mouth or nose. Following completion of the standard diagnostic bronchoscopy studies (i.e. bronchoalveolar lavage, brushing and endo/transbronchial biopsy of the affected region), brushings were obtained via three endoscopic cytobrushes from the right mainstem bronchus. The cytobrush was rubbed over the surface of the airway several times and then retracted from the bronchoscope so that epithelial cells could be placed immediately in TRIzol solution and kept at −80° C. until RNA isolation was performed.

Given that these patients were undergoing bronchoscopy for clinical indications, the risks from our study were minimal, with less than a 5% risk of a small amount of bleeding from these additional brushings. The clinical bronchoscopy was prolonged by approximately 3-4 minutes in order to obtain the research samples. All participating subjects were recruited by IRB-approved protocols for informed consent, and participation in the study did not affect subsequent treatment. Patient samples were given identification numbers in order to protect patient privacy.

Microarray Data Acquisition and Preprocessing

Microarray data acquisition: 6-8 µg of total RNA from bronchial epithelial cells were converted into double-stranded cDNA with SuperScript II reverse transcriptase (Invitrogen) using an oligo-dT primer containing a T7 RNA polymerase promoter (Genset, Boulder, Colo.). The ENZO Bioarray RNA transcript labeling kit (Enzo Life Sciences, Inc, Farmingdale, N.Y.) was used for in vitro transcription of the purified double stranded cDNA. The biotin-labeled cRNA was then purified using the RNeasy kit (Qiagen) and fragmented into fragments of approximately 200 base pairs by alkaline treatment. Each cRNA sample was then hybridized overnight onto the Affymetrix HG-U133A array followed by a washing and staining protocol. Confocal laser scanning (Agilent) was then performed to detect the streptavidin-labeled fluor.

Preprocessing of array data via RMA: The Robust Multichip Average (RMA) algorithm was used for background adjustment, normalization, and probe-level summarization of the microarray samples in this study (Irizarry R A, et al., Summaries of Affymetrix GeneChip probe level data. Nucleic Acids Res 2003; 31(4):e15.). RMA expression measures were computed using the R statistical package and the justRMA function in the Affymetrix Bioconductor package. A total of 296 CEL files from airway epithelial samples included in this study as well as those previously processed in our lab were analyzed using RMA. RMA was chosen for probe-level analysis instead of Micro array Suite 5.0 because it maximized the correlation coefficients observed between 7 pairs of technical replicates (Supplemental Table 4).

SUPPLEMENTAL TABLE 4

Pearson Correlation Coefficients (22,215 probe-sets)

|  | Affy | log2Affy | RMA |
|---|---|---|---|
| Average | 0.972 | 0.903 | 0.985 |
| SD | 0.017 | 0.029 | 0.009 |
| Median | 0.978 | 0.912 | 0.987 |

Supplemental Table 4 shows the Average Pearson Correlations between 7 pairs of replicate samples where probe-set gene expression values were determined using Microarray Suite 5.0 (Affy), logged data from Microarray Suite 5.0 (log 2 Affy), and RMA. RMA maximizes the correlation between replicate samples.

Figure 7:
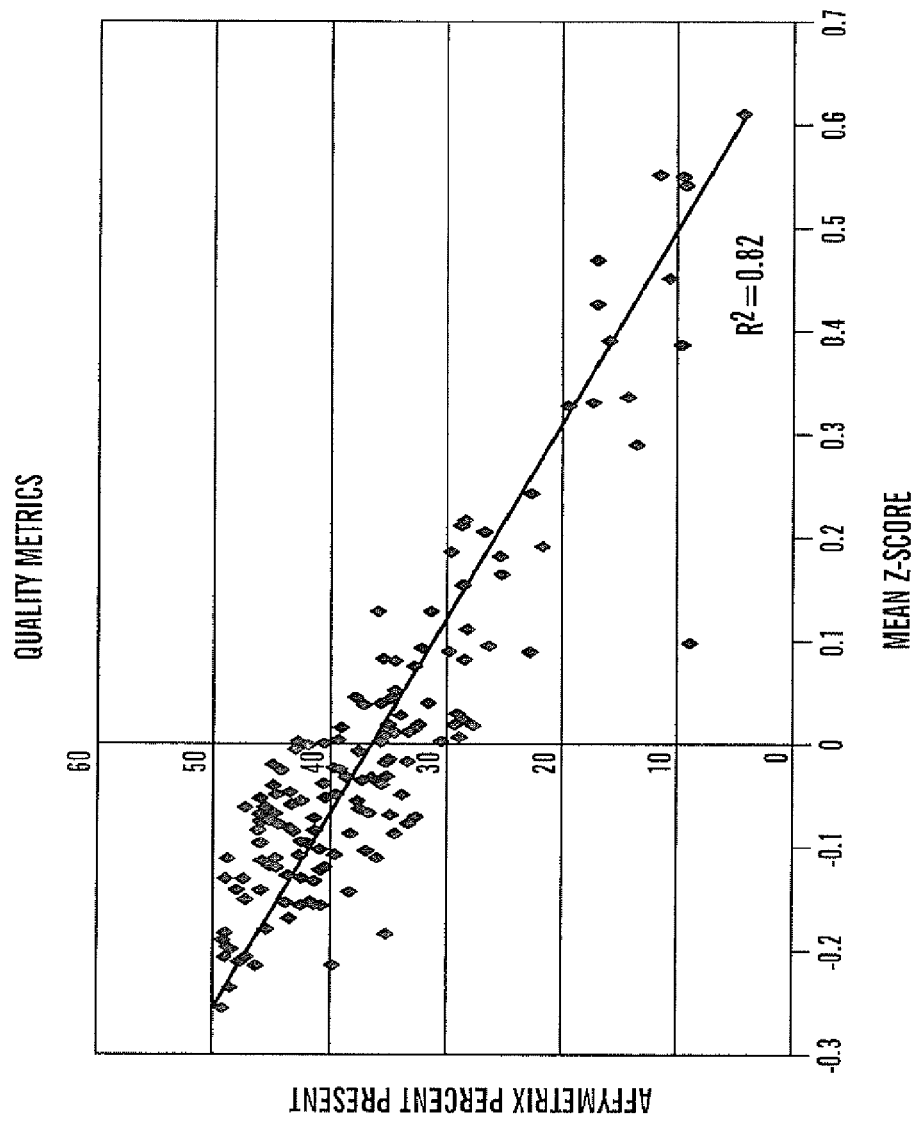
FIG. 7 shows a comparison of sample-quality metrics. The graph plots the Affymetrix MAS 5.0 percent present (y-axis) versus the z-score derived filter (x-axis). The two metrics have a correlation ($R^2$) of 0.82.

Sample filter: To filter out arrays of poor quality, each probeset on the array was z-score normalized to have a mean of zero and a standard deviation of 1 across all 152 samples. These normalized gene-expression values were averaged across all probe-sets for each sample. The assumption explicit in this analysis is that poor-quality samples will have probeset intensities that consistently trend higher or lower across all samples and thus have an average z-score that differs from zero. This average z-score metric correlates with Affymetrix MAS 5.0 quality metrics such as percent present (FIG. 7) and GAPDH 3'/5' ratio. Microarrays that had an average z-score with a value greater than 0.129 (~15% of the 152 samples) were filtered out. The resulting sample set consisted of 60 smokers with cancer and 69 smokers without cancer.

Prospective validation test set: CEL files for the additional 40 samples were added to the collection of airway epithelial CEL files described above, and the entire set was analyzed using RMA to derive expression values for the new samples. Microarrays that had an average z-score with a value greater than 0.129 (5 of the 40 samples) were filtered out. Class prediction of the 35 remaining prospective samples was conducted using the vote weights for the 80-predictive probesets derived from the training set of 77 samples using expression values computed in the section above.

Microarray Data Analysis

Class Prediction Algorithm: The 129-sample set (60 cancer samples, 69 no cancer samples) was used to develop a class-prediction algorithm capable of distinguishing between the two classes. One potentially confounding difference between the two groups is a difference in cumulative tobacco-smoke exposure as measured by pack-years. To insure that the genes chosen for their ability to distinguish patients with and without cancer in the training set were not simply distinguishing this difference in tobacco smoke exposure, the pack-years each patient smoked was included as a covariate in the training set ANCOVA gene filter.

In addition, there are differences in the pre-bronchoscopy clinical risk for lung cancer among the 129 patients. Three physicians reviewed each patient's clinical data (including demographics, smoking histories, and radiographic findings) and divided the patients into three groups: high, medium, and low pre-bronchoscopy risk for lung cancer (as described above). In order to control for differences in pre-bronchoscopy risk for lung cancer between the patients with and without a final diagnosis of lung cancer, the training set was constructed with roughly equal numbers of cancer and no cancer samples from a spectrum of lung cancer risk.

The weighted voting algorithm (Golub T R, et al. Molecular classification of cancer: class discovery and class prediction by gene expression monitoring. Science 1999; 286 (5439):531-537) was implemented as the class prediction method, with several modifications to the gene-selection methodology. Genes that varied between smokers with and without cancer in the training set samples after adjusting for tobacco-smoke exposure (p<0.05) were identified using an ANCOVA with pack-years as the covariate. Further gene selection was performed using the signal to noise metric and internal cross-validation where the 40 most consistently up- and the 40 most consistently down-regulated probesets were identified. The internal cross validation involved leaving 30% of the training samples out of each round of cross-validation, and selecting genes based on the remaining 70% of the samples. The final gene committee consisted of eighty probesets that were identified as being most frequently up-regulated or down-regulated across 50 rounds of internal cross-validation. The parameters of this gene-selection algorithm were chosen to maximize the average accuracy, sensitivity and specificity obtained from fifty runs. This algorithm was implemented in R and yields results that are comparable to the original implementation of the weighted-voted algorithm in GenePattern when a specific training, test, and gene set are given as input.

After determination of the optimal gene-selection parameters, the algorithm was run using a training set of 77 samples to arrive at a final set of genes capable of distinguishing between smokers with and without lung cancer. The accuracy, sensitivity and specificity of this classifier were tested against 52 samples that were not included in the training set. The performance of this classifier in predicting the class of each test-set sample was assessed by comparing it to runs of the algorithm where either: 1) different training/tests sets were used; 2) the cancer status of the training set of 77 samples were randomized; or 3) the genes in the classifier were randomly chosen (see randomization section below for details).

Randomization: The accuracy, sensitivity, specificity, and area under the ROC curve (using the signed prediction strength as a continuous cancer predictor) for the 80-probeset predictor (above) were compared to 1000 runs of the algorithm using three different types of randomization. First, the class labels of the training set of 77 samples were permuted and the algorithm, including gene selection, was re-run 1000 times (referred to in Supplemental Table 5 as Random 1).

Supplemental Table 5 below shows results of a comparison between the actual classifier and random runs (explained above). Accur=Accuracy, Sens=Sensitivity, Spec=Specificity, AUC=area under the curve, and sd=standard deviation. All p-value are empirically derived.

SUPPLEMENTAL TABLE 5

|  | Accur | sd(Accur) | p-value | Sens | sd(Sens) | p-value | Spec | sd(Spec) | p-value | AUC | sd(AUC) | p-value |
|---|---|---|---|---|---|---|---|---|---|---|---|---|
| Actual Classifier | 0.827 |  |  | 0.8 |  |  | 0.844 |  |  | 0.897 |  |  |
| Random 1 | 0.491 | 0.171 | 0.018 | 0.487 | 0.219 | 0.114 | 0.493 | 0.185 | 0.015 | 0.487 | 0.223 | 0.004 |
| Random 2 | 0.495 | 0.252 | 0.078 | 0.496 | 0.249 | 0.173 | 0.495 | 0.263 | 0.073 | 0.495 | 0.309 | 0.008 |
| Random 3 | 0.495 | 0.193 | 0.021 | 0.491 | 0.268 | 0.217 | 0.498 | 0.17 | 0.006 | 0.492 | 0.264 | 0.007 |

The second randomization used the 80 genes in the original predictor but permuted the class labels of the training set samples over 1000 runs to randomize the gene weights used in the classification step of the algorithm (referred to in Supplemental Table 5 as Random 2).

In both of these randomization methods, the class labels were permuted such that half of the training set samples was labeled correctly. The third randomization method involved randomly selecting 80 probesets for each of 1000 random classifiers (referred to in Supplemental Table 5 as Random 3).

The p-value for each metric and randomization method shown indicate the percentage of 1000 runs using that randomization method that exceeded or was equal to the performance of the actual classifier.

In addition to the above analyses, the actual classifier was compared to 1000 runs of the algorithm where different training/test sets were chosen but the correct sample labels were retained. Empirically derived p-values were also computed to compare the actual classifier to the 1000 runs of the algorithm (see Supplemental Table 6). These data indicate that the actual classifier was derived using a representative training and test set.

SUPPLEMENTAL TABLE 6

|  | Accur | sd(Accur) | p-value | Sens | sd(Sens) | p-value | Spec | sd(Spec) | p-value | AUC | sd(AUC) | p-value |
|---|---|---|---|---|---|---|---|---|---|---|---|---|
| Actual Classifier | 0.827 |  |  | 0.8 |  |  | 0.844 |  |  | 0.897 |  |  |
| 1000 Runs | 0.784 | 0.054 | 0.283 | 0.719 | 0.104 | 0.245 | 0.83 | 0.06 | 0.407 | 0.836 | 0.053 | 0.108 |

Supplemental Table 6 above shows a comparison of actual classifier to 1000 runs of the algorithm with different training/test sets.

Finally, these 1000 runs of the algorithm were also compared to 1000 runs were the class labels of different training sets were randomized in the same way as described above. Empirically derived p-values were computed to compare 1000 runs to 1000 random runs (Supplemental Table 7).

SUPPLEMENTAL TABLE 7

|  | Accur | sd(Accur) | p-value | Sens | sd(Sens) | p-value | Spec | sd(Spec) | p-value | AUC | sd(AUC) | p-value |
|---|---|---|---|---|---|---|---|---|---|---|---|---|
| 1000 Runs | 0.784 | 0.054 |  | 0.719 | 0.104 |  | 0.83 | 0.06 |  | 0.836 | 0.053 |  |
| 1000 Random Runs | 0.504 | 0.126 | 0.002 | 0.501 | 0.154 | 0.025 | 0.506 | 0.154 | 0.003 | 0.507 | 0.157 | 0.001 |

Supplemental Table 7 above shows comparison of runs of the algorithm using different training/test sets to runs where the class labels of the training sets were randomized (1000 runs were conducted).

The distribution of the prediction accuracies summarized in Supplemental Tables 6 and 7 is shown in FIG. 8.

Characteristics of the 1000 additional runs of the algorithm: The number of times a sample in the test set was classified correctly and its average prediction strength was computed across the 1000 runs of the algorithm. The average prediction strength when a sample was classified correctly was 0.54 for cancers and 0.61 for no cancers, and the average prediction strength when a sample was misclassified was 0.31 for cancer and 0.37 for no cancers. The slightly higher prediction strength for smokers without cancer is reflective of the fact that predictors have a slightly higher specificity on average. Supplemental FIG. 3 shows that samples that are consistently classified correctly or classified incorrectly are classified with higher confidence higher average prediction strength). Interestingly, 64% of the samples that are consistently classified incorrectly (incorrect greater than 95% of the time, n=22 samples) are samples from smokers that do not currently have a final diagnosis of cancer. This significantly higher false-positive rate might potentially reflect the ability of the biomarker to predict future cancer occurrence or might indicate that a subset of smokers with a cancer-predisposing gene-expression phenotype are protected from developing cancer through some unknown mechanism.

In order to further assess the stability of the biomarker gene committee, the number of times the 80-predictive probesets used in the biomarker were selected in each of the 1000 runs (Supplemental Table 6) was examined. (See FIG. 10A) The majority of the 80-biomarker probesets were chosen frequently over the 1000 runs (37 probesets were present in over 800 runs, and 58 of the probesets were present in over half of the runs). For purposes of comparison, when the cancer status of the training set samples are randomized over 1000 runs (Supplemental Table 7), the most frequently selected probeset is chosen 66 times, and the average is 7.3 times. (See FIG. 10B).

Comparison of RMA vs. MAS 5.0 and weighted voting vs. PAM: To evaluate the robustness of our ability to use airway gene expression to classify smokers with and without lung cancer, we examined the effect of different class-prediction and data preprocessing algorithms. We tested the 80-probesets in our classifier to generate predictive models using the Prediction Analysis of Microarrays (PAM) algorithm (Tibshirani R, et al., Diagnosis of multiple cancer types by shrunken centroids of gene expression. Proc Natl Acad Sci USA 2002; 99(10):6567-6572), and we also tested the ability of the WV algorithm to use probeset level data that had been derived using the MAS 5.0 algorithm instead of RMA. The accuracy of the classifier was similar when microarray data was preprocessed in MAS 5.0 and when the PAM class prediction algorithm was used (see Supplemental Table 8).

SUPPLEMENTAL TABLE 8

|  | Accuracy | Sensitivity | Specificity |
|---|---|---|---|
| WV-RMA data | 82.69% | 80% | 84.38% |
| PAM-RMA data | 86.54% | 90% | 84.38% |
| WV-MAS5 data | 82.69% | 80% | 84.38% |
| PAM-MAS5 data | 86.54% | 95% | 81.25% |

Supplemental Table 8 shows a comparison of accuracy, sensitivity and specificity for our 80 probeset classifier on the 52 sample test set using alternative microarray data preprocessing algorithms and class prediction algorithms.

Prediction strength: The Weighted voting algorithm predicts a sample's class by summing the votes each gene on the class prediction committee gives to one class versus the other. The level of confidence with which a prediction is made is captured by the Prediction Strength (PS) and is calculated as follows:

$$PS = \frac{V_{winning} - V_{losing}}{V_{winning} + V_{losing}}$$

$V_{winning}$ refers to the total gene committee votes for the winning class and $V_{losing}$ refers to the total gene committee votes for the losing class. Since $V_{winning}$ is always greater than $V_{losing}$, PS confidence varies from 0 (arbitrary) to 1 (complete confidence) for any given sample.

Figure 12:
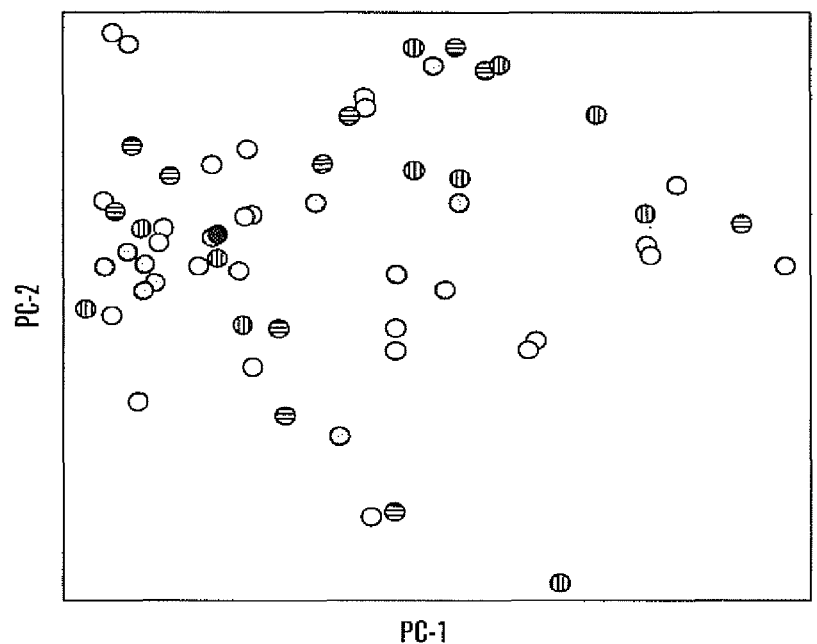
FIG. 12 shows homogeneity of gene expression in large airway samples from smokers with lung cancer of varying cell types. Principal Component Analysis (PCA) was performed on the gene-expression measurements for the 80 genes in our predictor and all of the airway epithelium samples from patients with lung cancer. Gene expression measurements were Z(0,1) normalized prior to PCA. The graph shows the sample loadings for the first two principal components which together account for 58% of the variation among samples from smokers with cancer. There is no apparent separation of the samples with regard to lung tumor subtype.

In our test set, the average PS for our gene profile's correct predictions (43/52 test samples) is 0.73 (+/− 0.27), while the average PS for the incorrect predictions (9/52 test samples) is much lower: 0.49 (+/− 0.33; p<z; Student T-Test). This result shows that, on average, the Weighted Voting algorithm is more confident when it is making a correct prediction than when it is making an incorrect prediction. This result holds across 1000 different training/test set pairs (FIG. 11):

Cancer cell type: To determine if the tumor cell subtype affects the expression of genes that distinguish airway epithelium from smokers with and without lung cancer, Principal Component Analysis (PCA) was performed on the gene-expression measurements for the 80 probesets in our predictor and all of the airway epithelium samples from patients with lung cancer (FIG. 12). Gene expression measurements were Z(0,1) normalized prior to PCA. There is no apparent separation of the samples with regard to cancer subtype.

Link to Lung Cancer Tissue Microarray Dataset

Preprocessing of Bhattacharjee data: The 254 CEL files from HgU95Av2 arrays used by Bhattacharjee et al. (Classification of human lung carcinomas by mRNA expression profiling reveals distinct adenocarcinoma subclasses. Proc Natl Acad Sci USA 2001; 98(24):13790-13795) were downloaded from the MIT Broad Institute's database available through internet (broad.mit.edu/mpr/lung). RMA-derived expression measurements were computed using these CEL files as described above. Technical replicates were filtered by choosing one at random to represent each patient. In addition, arrays from carcinoid samples and patients who were indicated to have never smoked were excluded, leaving 151 samples. The z-score quality filter described above was applied to this data set resulting in 128 samples for further analysis (88 adenocarcinomas, 3 small cell, 20 squamous, and 17 normal lung samples).

Probesets were mapped between the HGU133A array and HGU95Av2 array using Chip Comparer at the Duke University's database available through the world wide web at tenero.duhs.duke.edu/genearray/perl/chip/chipcomparer.pl. 64 probesets on the HGU95Av2 array mapped to the 80-predictive probesets. The 64 probesets on the HGU95Av2 correspond to 48 out of the 80 predictive probesets (32/80 predictive probesets have no clear corresponding probe on the HGU95Av2 array).

Analyses of Bhattacharjee dataset: In order to explore the expression of genes that we identified as distinguishing large airway epithelial cells from smokers with and without lung cancer in lung tumors profiled by Bhattacharjee, two different analyses were performed. Principal component analysis was used to organize the 128 Bhattacharjee samples according to the expression of the 64 mapped probesets. Principal component analysis was conducted in R using the package prcomp on the z-score normalized 128 samples by 64 probeset matrix. The normal and malignant samples in the Bhattacharjee dataset appear to separate along principal component 1 (see FIG. 17). To assess the significance of this result, the principal component analysis was repeated using the 128 samples and 1000 randomly chosen sets of 64 probesets. The mean difference between normal and malignant samples was calculated based on the projected values for principal component 1 for the actual 64 probesets and for each of the 1000 random sets of 64 probesets. The mean difference between normal and malignant from the 1000 random gene sets was used to generate a null distribution. The observed difference between the normal and malignant samples using the biomarker probesets was greater than the difference observed using randomly selected genes (p=0.026 for mean difference and p=0.034 for median difference).

The second analysis involved using the weighted voted algorithm to predict the class of 108 samples in the Bhattacharjee dataset using the 64 probesets and a training set of 10 randomly chosen normal tissues and 10 randomly chosen tumor tissues. The samples were classified with 89.8% accuracy, 89.1% sensitivity, and 100% specificity (see Supplemental Table 9 below, Single Run). To examine the significance of these results, the weighted voted algorithm was re-run using two types of data randomization. First, the class labels of the training set of 20 samples were permuted and the algorithm, including gene selection, was re-run 1000 times (referred to in Supplemental Table 9 as Random 1). The second randomization involved permuting the class labels of the training set of 20 samples and re-running the algorithm 1000 times keeping the list of 64-probsets constant (referred to in Supplemental Table 9 as Random 2). In the above two types of randomization, the class labels were permuted such that half the samples were correctly labeled. The p-value for each metric and randomization method shown indicate the percentage of 1000 runs using that randomization method that exceeded or were equal to the performance of the actual classifier. Genes that distinguish between large airway epithelial cells from smokers with and without cancer are significantly better able to distinguish lung cancer tissue from normal lung tissue than any random run where the class labels of the training set are randomized.

SUPPLEMENTAL TABLE 9

|  | Accur | sd(Accur) | p-value | Sens | sd(Sens) | p-value | Spec | sd(Spec) | p-value | AUC | sd(AUC) | p-value |
|---|---|---|---|---|---|---|---|---|---|---|---|---|
| Single Run | 0.898 |  |  | 0.891 |  |  | 1 |  |  | 0.984 |  |  |
| Random 1 | 0.486 | 0.218 | 0.007 | 0.486 | 0.217 | 0.008 | 0.484 | 0.352 | 0.131 | 0.481 | 0.324 | 0.005 |
| Random 2 | 0.498 | 0.206 | 0.009 | 0.499 | 0.201 | 0.011 | 0.494 | 0.344 | 0.114 | 0.494 | 0.324 | 0.014 |

Supplemental Table 9 above shows results of a comparison between the predictions of the Bhattacharjee samples using the 64 probesets that map to a subset of the 80-predictive probesets and random runs (explained above). Accur=Accuracy, Sens=Sensitivity, Spec=Specificity, AUC=area under the curve, and sd=standard deviation.

Real Time PCR: Quantitative RT-PCR analysis was used to confirm the differential expression of a seven genes from our classifier. Primer sequences for the candidate genes and a housekeeping gene, the 18S ribosomal subunit, were designed with PRIMER EXPRESS® software (Applied Biosystems) (see Supplemental Table 10).

SUPPLEMENTAL TABLE 10

Candidate and housekeeping gene primers for real time PCR aasay

| Gene Symbol | Affy ID | Ensembl ID | Name | Forward Primer | Reverse Primer |
|---|---|---|---|---|---|
| BACH2 | 215907_at | ENSG00000 112182 | BTB and CNC homology 1, basic leucine zipper transcription factor 2 | TGGCAAAACCGCATCTCT AC(SEQ ID No. 1) | ACCACCATGCCCAGCTAA (SEQ ID No. 2) |

SUPPLEMENTAL TABLE 10-continued

Candidate and housekeeping gene primers for real time PCR assay

| Gene Symbol | Affy ID | Ensembl ID | Name | Forward Primer | Reverse Primer |
|---|---|---|---|---|---|
| DCLRE1C | 219678_x_at | ENSG00000152457 | DNA cross-link repair 1C | GCACTTTGAGGTGGGCAAT (SEQ ID No. 3) | CCAGGCTGGTGTCGAACTC (SEQ ID No. 4) |
| DUOX1 | 215800_at | ENSG00000137857 | dual oxidase 1 | GAGAGAAAGCAAAGGAGTGAACTT (SEQ ID No. 5) | CATGTGAGTCTGAAATTACAGCATT (SEQ ID No. 6) |
| FOS | 209189_at | ENSG00000170345 | v-fos FBJ murine osteosarcoma viral oncogene homolog | AGATGTAGCAAAACGCATGGA (SEQ ID No. 7) | CTCTGAAGTGTCACTGGGAACA (SEQ ID No. 8) |
| IL8 | 211506_s_at | ENSG00000169429 | interleukin 8 | GCTAAAGAACTTAGATGTCAGTGCAT (SEQ ID No. 9) | GGTGGAAAGGTTTGGAGTATGTC (SEQ ID No. 10) |
| RAB1A | 207791_s_at | ENSG00000138069 | RAB1A, member RAS oncogene family | GGAGCCCATGGCATCATA (SEQ ID No. 11) | TTGAAGGACTCCTGATCTGTCA (SEQ ID No. 12) |
| 18S | | | | TTTCGGAACTGAGGCCATG (SEQ ID No. 15) | TTTCGCTCTGGTCCGTCTT (SEQ ID No. 16) |
| GAPDH | | | | TGCACCACCAACTGCTTAGC (SEQ ID No. 17) | GGCATGGACTGTGGTCATGAG (SEQ ID No. 18) |
| HPRT1 | | | | TGACACTGGCAAAACAATGCA (SEQ ID No. 19) | GGTCCTTTTCACCAGCAAGCT (SEQ ID No. 20) |
| SDHA | | | | TGGGAACAAGAGGGCATCTG (SEQ ID No. 21) | CCACCACTGCATCAAATTCATG (SEQ ID No. 22) |
| TBP | | | | TGCACAGGAGCCAAGAGTGAA (SEQ ID No. 23) | CACATCACAGCTCCCCACCA (SEQ ID No. 24) |
| YWHAZ | | | | ACTTTTGGTACATTGTGGCTTCAA (SEQ ID No. 25) | CCGCCAGGACAAACCAGTAT (SEQ ID No. 26) |

Primer sequences for five other housekeeping genes (HPRT1, SDHA, YWHAZ, GAPDH, and TBP) were adopted from Vandesompele et al. (Accurate normalization of real-time quantitative RT-PCR data by geometric averaging of multiple internal control genes. Genome Biol 2002; 3(7)). RNA samples (1 μg of the RNA used in the microarray experiment) were treated with DNAfree (Ambion, Austin, Tex.), according to the manufacturer's protocol, to remove contaminating genomic DNA. Total RNA was reverse-transcribed using random hexamers (Applied Biosystems) and SuperScript II reverse transcriptase (Invitrogen). The resulting first-strand cDNA was diluted with nuclease-free water (Ambion) to 5 ng/μl. PCR amplification mixtures (25 μl) contained 10 ng template cDNA, 12.5 μl of 2× SYBR Green PCR master mix (Applied Biosystems) and 300 nM forward and reverse primers. Forty cycles of amplification and data acquisition were carried out in an Applied Biosystems 7500 Real Time PCR System. Threshold determinations were automatically performed by Sequence Detection Software (version 1.2.3) (Applied Biosystems) for each reaction. All real-time PCR experiments were carried out in triplicate on each sample (6 samples total; 3 smokers with lung cancer and 3 smokers without lung cancer).

Figure 13:
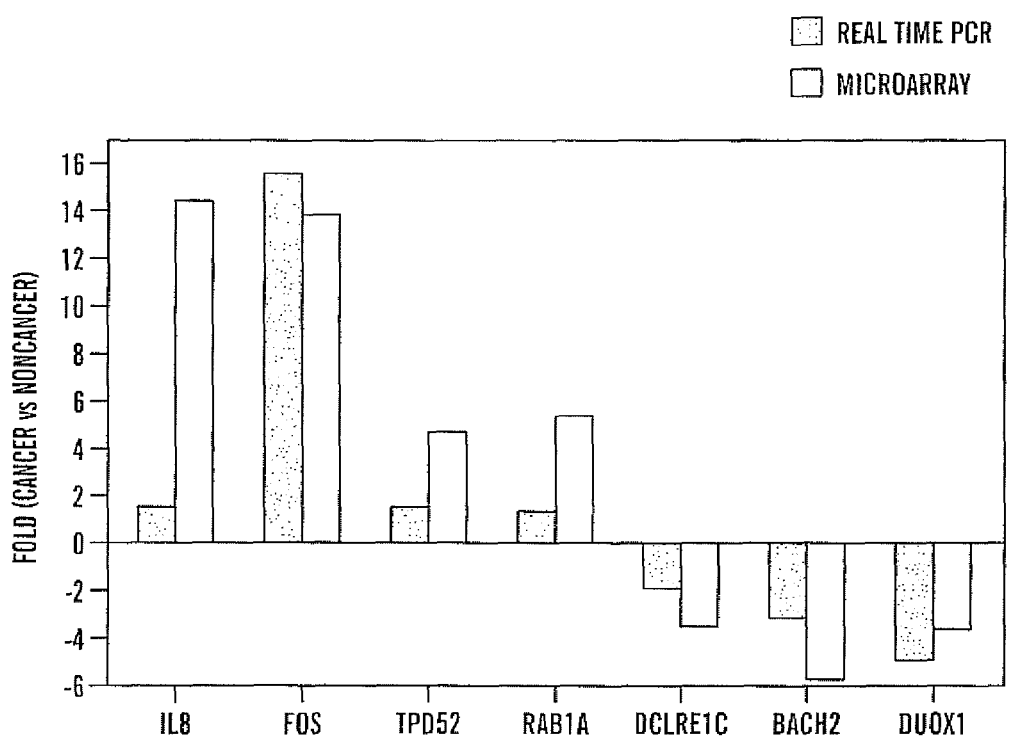
FIG. 13 shows real time RT-PCR and microarray data for selected genes distinguishing smokers with and without cancer. Fold change for each gene is shown as the ratio of average expression level of cancer group (n=3) to the average expression of non-cancer group (n=3). Four genes (IL8, FOS, TPD52, and RAB1A) were found to be up-regulated in cancer group on both microarray and RT-PCR platforms; three genes (DCLRE1C, BACH2, and DUOX1) were found to be down-regulated in cancer group on both platforms.

Data analysis was performed using the geNorm tool (Id.). Three genes (YWHAZ, GAPDH, and TBP) were determined to be the most stable housekeeping genes and were used to normalize all samples. Data from the QRT-PCR for 7 genes along with the microarray results for these genes is shown in FIG. 13.

REFERENCES (1) Parkin D M, et al., C A Cancer J Clin 2005; 55(2):74-108.
(2) Shields P G. Ann Oncol 1999; 10 Suppl 5:S7-11.
(3) Hirsch F R, et al., Clin Cancer Res 2001; 7(1):5-22.
(4) Jett J R. Clin Cancer Res 2005; 11(13 Pt 2):4988s-4992s.
(5) Macredmond R, et al., Thorax 2006; 61(1):54-56.
(6) Postmus P E. Chest 2005; 128(1):16-18.
(7) Mazzone P, et al., Clin Chest Med 2002; 23(1):137-58, ix.

(8) Schreiber G, and McCrory D C. Chest 2003; 123(1 Suppl): 15S-128S.
(9) Janssen-Heijnen M L, et al., Epidemiology 2001; 12(2): 256-258.
(10) Salomaa E R, et al., Chest 2005; 128(4):2282-2288.
(11) Auerbach O, et al., Arch Environ Health 1970; 21(6): 754-768.
(12) Powell C A, et al., Clin Cancer Res 1999; 5(8):2025-2034.
(13) Wistuba I I, et al., J Natl Cancer Inst 1997; 89(18): 1366-1373.
(14) Franklin W A, et al., J Clin Invest 1997; 100(8):2133-2137.
(15) Guo M, et al., Clin Cancer Res 2004; 10(15):5131-5136.
(16) Miyazu Y M, et al., Cancer Res 2005; 65(21):9623-9627.
(17) Spira A, et al., Proc Natl Acad Sci USA 2004; 101(27): 10143-10148.
(18) Bolstad B M, et al., Bioinformatics 2003; 19(2):185-193.
(19) Golub T R, et al, Science 1999; 286(5439):531-537.
(20) Tibshirani R, et al., Proc Natl Acad Sci USA 2002; 99(10):6567-6572.
(21) Bhattacharjee A, et al., Proc Natl Acad Sci USA 2001; 98(24):13790-13795.
(22) Subramanian A, et al., Proc Natl Acad Sci USA 2005; 102(43); 15545-15550.
(23) Simon R, et al., J Natl Cancer Inst 2003; 95(1):14-18.
(24) Cheng K W, et al., Cancer Res 2005; 65(7):2516-2519.
(25) Shimada K, et al., Br J Cancer 2005; 92(10):1915-1921.
(26) Xie K. Cytokine Growth Factor Rev 2001; 12(4):375-391.
(27) Campa D, et al., Cancer Epidemiol Biomarkers Prev 2005; 14(10):2457-2458.
(28) Arimura Y, et al., Anticancer Res. 24, 4051-4057. 2004.
(29) Coussens L M, and Werb Z. Nature 2002; 420(6917): 860-867.
(30) Godschalk R, et al., Carcinogenesis 2002; 23(12):2081-2086.
(31) Kamio T, et al., Blood 2003; 102(9):3317-3322

SEQUENCE LISTING (2650 sequences)

SEQ ID NO: 1 - DNA, 20 bp, Artificial Sequence
  primer for 215907_at
tggcaaaaccgcatctctac

SEQ ID NO: 2 - DNA, 18 bp, Artificial Sequence
  primer for 215907_at
accaccatgcccagctaa

SEQ ID NO: 3 - DNA, 19 bp, Artificial Sequence
  primer for 219678_x_at
gcactttgaggtgggcaat

SEQ ID NO: 4 - DNA, 19 bp, Artificial Sequence
  primer for 219678_x_at
ccaggctggtgtcgaactc

SEQ ID NO: 5 - DNA, 24 bp, Artificial Sequence
  primer for 215800_at
gagagaaagcaaaggagtgaactt

SEQ ID NO: 6 - DNA, 25 bp, Artificial Sequence
  primer for 215800_at
catgtgagtctgaaattacagcatt

SEQ ID NO: 7 - DNA, 21 bp, Artificial Sequence
  primer for 209189_at
agatgtagcaaaacgcatgga

SEQ ID NO: 8 - DNA, 22 bp, Artificial Sequence
  primer for 209189_at
ctctgaagtgtcactgggaaca

SEQ ID NO: 9 - DNA, 26 bp, Artificial Sequence
  primer for 211506_s_at
gctaaagaacttagatgtcagtgcat

SEQ ID NO: 10 - DNA, 23 bp, Artificial Sequence
  primer for 211506_s_at
ggtggaaaggtttggagtatgtc

SEQ ID NO: 11 - DNA, 18 bp, Artificial Sequence
  primer for 207791_s_at
ggagcccatggcatcata

SEQ ID NO: 12 - DNA, 22 bp, Artificial Sequence
  primer for 207791_s_at
ttgaaggactcctgatctgtca

SEQ ID NO: 13 - DNA, 25 bp, Artificial Sequence
  probe sequence for 201804_x_at
ctgaagcgcagaaagctcggccggt

SEQ ID NO: 14 - DNA, 25 bp, Artificial Sequence
  probe sequence for 201804_x_at
gggcaccgtcatgtatgtaggtctc

SEQ ID NO: 15 - DNA, 25 bp, Artificial Sequence
  probe sequence for 201804_x_at
ggtctcacagatttcaagcctggct

SEQ ID NO: 16 - DNA, 25 bp, Artificial Sequence
  probe sequence for 201804_x_at
gcctggctactggattggtgtccgc

SEQ ID NO: 17 - DNA, 25 bp, Artificial Sequence
  probe sequence for 201804_x_at
gtgtccgctatgatgagccactggg

SEQ ID NO: 18 - DNA, 25 bp, Artificial Sequence
  probe sequence for 201804_x_at
aatgccaggccaagtatggcgcctt

SEQ ID NO: 19 - DNA, 25 bp, Artificial Sequence
  probe sequence for 201804_x_at
atggcgcctttgtcaagccagcagt

SEQ ID NO: 20 - DNA, 25 bp, Artificial Sequence
  probe sequence for 201804_x_at
gccagcagtcgtgacggtgggggac

SEQ ID NO: 21 - DNA, 25 bp, Artificial Sequence
  probe sequence for 201804_x_at
tgacacctaaggaattcccctgctt

SEQ ID NO: 22 - DNA, 25 bp, Artificial Sequence
  probe sequence for 201804_x_at
tctcctgaccccattttaattttat

SEQ ID NO: 23 - DNA, 25 bp, Artificial Sequence
  probe sequence for 201804_x_at
tttattcattttttcctttgccatt

SEQ ID NO: 24 - DNA, 25 bp, Artificial Sequence
  probe sequence for 203588_s_at
tctaccattcagctgccattcataa

SEQ ID NO: 25 - DNA, 25 bp, Artificial Sequence
  probe sequence for 203588_s_at
gcagcatctccagtgacaagtttga

SEQ ID NO: 26 - DNA, 25 bp, Artificial Sequence
  probe sequence for 203588_s_at
atgggaatgtcgtttggcctggagt

SEQ ID NO: 27 - DNA, 25 bp, Artificial Sequence
  probe sequence for 203588_s_at
ggagtcaggcaaatgctctctggag

SEQ ID NO: 28 - DNA, 25 bp, Artificial Sequence
  probe sequence for 203588_s_at
tgaaacttgcgaaatccctggtgcc

SEQ ID NO: 29 - DNA, 25 bp, Artificial Sequence
  probe sequence for 203588_s_at
atatctccacaggaccttcttggtt

SEQ ID NO: 30 - DNA, 25 bp, Artificial Sequence
  probe sequence for 203588_s_at
tcagggactacttctgaactctacc

SEQ ID NO: 31 - DNA, 25 bp, Artificial Sequence
  probe sequence for 203588_s_at
aatttagacctgaccactggtgcca

SEQ ID NO: 32 - DNA, 25 bp, Artificial Sequence
  probe sequence for 203588_s_at
agtggccttagcaactgggcagttc

SEQ ID NO: 33 - DNA, 25 bp, Artificial Sequence
  probe sequence for 203588_s_at
caaacagtcaccagtccagcagtgc

SEQ ID NO: 34 - DNA, 25 bp, Artificial Sequence
  probe sequence for 203588_s_at
attcctcctccccagaataaagaca

SEQ ID NO: 35 - DNA, 25 bp, Artificial Sequence
  probe sequence for 219920_s_at
ggccagaactgcagcattggcccca

SEQ ID NO: 36 - DNA, 25 bp, Artificial Sequence
  probe sequence for 219920_s_at
ttggccccaatgtgagcctgggacc

SEQ ID NO: 37 - DNA, 25 bp, Artificial Sequence
  probe sequence for 219920_s_at
cctggcgtggtggtcgaagatggtg

SEQ ID NO: 38 - DNA, 25 bp, Artificial Sequence
  probe sequence for 219920_s_at
gatgagctctacctcaacggagcca

SEQ ID NO: 39 - DNA, 25 bp, Artificial Sequence
  probe sequence for 219920_s_at
tgctgccccacaagtctattggcga

SEQ ID NO: 40 - DNA, 25 bp, Artificial Sequence
  probe sequence for 219920_s_at
ccagagcctcgtatcatcatgtgag

SEQ ID NO: 41 - DNA, 25 bp, Artificial Sequence
  probe sequence for 219920_s_at
agtgctggcctgacacatcagaaga

SEQ ID NO: 42 - DNA, 25 bp, Artificial Sequence
  probe sequence for 219920_s_at
catcagaagaccctggacttgtcat

SEQ ID NO: 43 - DNA, 25 bp, Artificial Sequence
  probe sequence for 219920_s_at
gtcattatttgtctggggggcactg

SEQ ID NO: 44 - DNA, 25 bp, Artificial Sequence
  probe sequence for 219920_s_at
gtggacatcatctggcaggatccct

SEQ ID NO: 45 - DNA, 25 bp, Artificial Sequence
  probe sequence for 219920_s_at
cccactccctcaagaagggccaggg

SEQ ID NO: 46 - DNA, 25 bp, Artificial Sequence
  probe sequence for 201608_s_at
aatcaagggctgtctcgtgactgct

SEQ ID NO: 47 - DNA, 25 bp, Artificial Sequence
  probe sequence for 201608_s_at
tctcgtgactgcttcagctgacaaa

SEQ ID NO: 48 - DNA, 25 bp, Artificial Sequence
  probe sequence for 201608_s_at
tcatgttgccctgatttgccattta

SEQ ID NO: 49 - DNA, 25 bp, Artificial Sequence
  probe sequence for 201608_s_at
agaagggcttcgggtctgggatata

SEQ ID NO: 50 - DNA, 25 bp, Artificial Sequence
  probe sequence for 201608_s_at
gagagaggcttgttcttgggagtgc

SEQ ID NO: 51 - DNA, 25 bp, Artificial Sequence
  probe sequence for 201608_s_at
tcatctattagtggcccttttggca

SEQ ID NO: 52 - DNA, 25 bp, Artificial Sequence
  probe sequence for 201608_s_at
cagcaggagctcagatacacccatg

SEQ ID NO: 53 - DNA, 25 bp, Artificial Sequence
  probe sequence for 201608_s_at
atctaatttcctgcttaccttaact

SEQ ID NO: 54 - DNA, 25 bp, Artificial Sequence
  probe sequence for 201608_s_at
atgttccatgcgtggcagcaaccat

SEQ ID NO: 55 - DNA, 25 bp, Artificial Sequence
  probe sequence for 201608_s_at
gtggcaccacaaatatccggtcttt

SEQ ID NO: 56 - DNA, 25 bp, Artificial Sequence
  probe sequence for 201608_s_at
ttgtgcttgctcttcagatggatgg

SEQ ID NO: 57 - DNA, 25 bp, Artificial Sequence
  probe sequence for 202857_at
ggggaacagattgatccttccaccc

SEQ ID NO: 58 - DNA, 25 bp, Artificial Sequence
  probe sequence for 202857_at
tccacccatcgcaagaactacgtac

SEQ ID NO: 59 - DNA, 25 bp, Artificial Sequence
  probe sequence for 202857_at
tacgtacgtgtagtgggccggaatg

SEQ ID NO: 60 - DNA, 25 bp, Artificial Sequence
  probe sequence for 202857_at
gacctacaaggcatccgaatcgact

SEQ ID NO: 61 - DNA, 25 bp, Artificial Sequence
  probe sequence for 202857_at
tcgactcagatattagcggcaccct

SEQ ID NO: 62 - DNA, 25 bp, Artificial Sequence
  probe sequence for 202857_at
cggcaccctcaagtttgcgtgtgag

SEQ ID NO: 63 - DNA, 25 bp, Artificial Sequence
  probe sequence for 202857_at
tgaactcattgaattcttttcccga

SEQ ID NO: 64 - DNA, 25 bp, Artificial Sequence
  probe sequence for 202857_at
cgaacagatctttgtgaccatgccc

SEQ ID NO: 65 - DNA, 25 bp, Artificial Sequence
  probe sequence for 202857_at
accatgccctgcacatatcgcatga

SEQ ID NO: 66 - DNA, 25 bp, Artificial Sequence
  probe sequence for 202857_at
gagctatgaaccactggagcagccc

SEQ ID NO: 67 - DNA, 25 bp, Artificial Sequence
  probe sequence for 202857_at
gcccacactggcttgatggatcacc

SEQ ID NO: 68 - DNA, 25 bp, Artificial Sequence
  probe sequence for 219203_at
cctgtccgtcatgttggaggtcgcc

SEQ ID NO: 69 - DNA, 25 bp, Artificial Sequence
  probe sequence for 219203_at
tcgccctcaaccaggtggatgtgtg

SEQ ID NO: 70 - DNA, 25 bp, Artificial Sequence
  probe sequence for 219203_at
gtctggtggtggctggttactacca

SEQ ID NO: 71 - DNA, 25 bp, Artificial Sequence
  probe sequence for 219203_at
gttactaccatgccaatgcagctgt

SEQ ID NO: 72 - DNA, 25 bp, Artificial Sequence
  probe sequence for 219203_at
gcagctgtgaacgatcagagccctg

SEQ ID NO: 73 - DNA, 25 bp, Artificial Sequence
  probe sequence for 219203_at
gaattcttccctgatgcagtactta

SEQ ID NO: 74 - DNA, 25 bp, Artificial Sequence
  probe sequence for 219203_at
tctccgctgggtccctaaggataag

SEQ ID NO: 75 - DNA, 25 bp, Artificial Sequence
  probe sequence for 219203_at
ggcagatggtgggagctctactgga

SEQ ID NO: 76 - DNA, 25 bp, Artificial Sequence
  probe sequence for 219203_at
tactggaagatcgggcccaccagca

SEQ ID NO: 77 - DNA, 25 bp, Artificial Sequence
  probe sequence for 219203_at
cagcaccttgtggactttgactgcc

SEQ ID NO: 78 - DNA, 25 bp, Artificial Sequence
  probe sequence for 219203_at
tgccaccttgatgacatccggcagg

SEQ ID NO: 79 - DNA, 25 bp, Artificial Sequence
  probe sequence for 211759_x_at
gctctttcctgaagcgcagcaagct

SEQ ID NO: 80 - DNA, 25 bp, Artificial Sequence
  probe sequence for 211759_x_at
gggcaccgtcatgtatgtaggtctc

SEQ ID NO: 81 - DNA, 25 bp, Artificial Sequence
  probe sequence for 211759_x_at
ggtctcacagatttcaagcctggct

SEQ ID NO: 82 - DNA, 25 bp, Artificial Sequence
  probe sequence for 211759_x_at
gcctggctactggattggtgtccgc

SEQ ID NO: 83 - DNA, 25 bp, Artificial Sequence
  probe sequence for 211759_x_at
gtgtccgctatgatgagccactggg

SEQ ID NO: 84 - DNA, 25 bp, Artificial Sequence
  probe sequence for 211759_x_at
aatgccaggccaagtatggcgcctt

SEQ ID NO: 85 - DNA, 25 bp, Artificial Sequence
  probe sequence for 211759_x_at
atggcgcctttgtcaagccagcagt

SEQ ID NO: 86 - DNA, 25 bp, Artificial Sequence
  probe sequence for 211759_x_at
gccagcagtcgtgacggtgggggac

SEQ ID NO: 87 - DNA, 25 bp, Artificial Sequence
  probe sequence for 211759_x_at
tgacacctaaggaattcccctgctt

SEQ ID NO: 88 - DNA, 25 bp, Artificial Sequence
  probe sequence for 211759_x_at
tctcctgaccccattttaattttat

SEQ ID NO: 89 - DNA, 25 bp, Artificial Sequence
  probe sequence for 211759_x_at
tttattcattttttcctttgccatt

SEQ ID NO: 90 - DNA, 25 bp, Artificial Sequence
  probe sequence for 218556_at
tagccggacggggatctgagctggc

SEQ ID NO: 91 - DNA, 25 bp, Artificial Sequence
  probe sequence for 218556_at
taaaccccaacacccgagtgatgaa

SEQ ID NO: 92 - DNA, 25 bp, Artificial Sequence
  probe sequence for 218556_at
tgcatatggttctactcagcatccc

SEQ ID NO: 93 - DNA, 25 bp, Artificial Sequence
  probe sequence for 218556_at
cttcagcattcctgttgtctggacc

SEQ ID NO: 94 - DNA, 25 bp, Artificial Sequence
  probe sequence for 218556_at
ctgaccaacgtcatccataacctgg

SEQ ID NO: 95 - DNA, 25 bp, Artificial Sequence
  probe sequence for 218556_at
taacctggctacgtatgtcttcctt

SEQ ID NO: 96 - DNA, 25 bp, Artificial Sequence
  probe sequence for 218556_at
aaggaaaggctcggctactgacaca

SEQ ID NO: 97 - DNA, 25 bp, Artificial Sequence
  probe sequence for 218556_at
tggactatgggctccagtttacctc

SEQ ID NO: 98 - DNA, 25 bp, Artificial Sequence
  probe sequence for 218556_at
tcctggccagcttctataccaagta

SEQ ID NO: 99 - DNA, 25 bp, Artificial Sequence
  probe sequence for 218556_at
gcctcattgctaagtgtactgctgc

SEQ ID NO: 100 - DNA, 25 bp, Artificial Sequence
  probe sequence for 218556_at
gttccatggggttcgtgtctttggc

SEQ ID NO: 101 - DNA, 25 bp, Artificial Sequence
  probe sequence for 214463_x_at
atgtctggccgcggcaaaggcggga

SEQ ID NO: 102 - DNA, 25 bp, Artificial Sequence
  probe sequence for 214463_x_at
gctaagcgccaccgtaaagtactgc

SEQ ID NO: 103 - DNA, 25 bp, Artificial Sequence
  probe sequence for 214463_x_at
gcgacaatatccagggcatcaccaa

SEQ ID NO: 104 - DNA, 25 bp, Artificial Sequence
  probe sequence for 214463_x_at
cttgctcgccgcggcggcgtgaagc

SEQ ID NO: 105 - DNA, 25 bp, Artificial Sequence
  probe sequence for 214463_x_at
atctccggcctcatctacgaggaga

SEQ ID NO: 106 - DNA, 25 bp, Artificial Sequence
  probe sequence for 214463_x_at
gactcgcggggtgctgaaggtgttc

SEQ ID NO: 107 - DNA, 25 bp, Artificial Sequence
  probe sequence for 214463_x_at
gttcctggagaacgtgatccgggac

SEQ ID NO: 108 - DNA, 25 bp, Artificial Sequence
  probe sequence for 214463_x_at
gacctatacagagcacgccaagcgc

SEQ ID NO: 109 - DNA, 25 bp, Artificial Sequence
  probe sequence for 214463_x_at
gtcaccgccatggatgtggtctacg

SEQ ID NO: 110 - DNA, 25 bp, Artificial Sequence
  probe sequence for 214463_x_at
tacggtttcggtggttgagcgtcct

SEQ ID NO: 111 - DNA, 25 bp, Artificial Sequence
  probe sequence for 214463_x_at
tgagcgtccttttctaccaataaaa

SEQ ID NO: 112 - DNA, 25 bp, Artificial Sequence
  probe sequence for 210434_x_at
atggcctggggctggcatttatctt

SEQ ID NO: 113 - DNA, 25 bp, Artificial Sequence
  probe sequence for 210434_x_at
ttatctttcctttcagcaagcacct

SEQ ID NO: 114 - DNA, 25 bp, Artificial Sequence
  probe sequence for 210434_x_at
gcacctcaaatttgccatgctggct

SEQ ID NO: 115 - DNA, 25 bp, Artificial Sequence
  probe sequence for 210434_x_at
aagagtgctctccatgctctaattt

SEQ ID NO: 116 - DNA, 25 bp, Artificial Sequence
  probe sequence for 210434_x_at
tacccctgagtgtggtcccacagga

SEQ ID NO: 117 - DNA, 25 bp, Artificial Sequence
  probe sequence for 210434_x_at
ctgccgctcagctttgatggaacaa

SEQ ID NO: 118 - DNA, 25 bp, Artificial Sequence
  probe sequence for 210434_x_at
gaaggggctgtcgtgtgtgtggccc

SEQ ID NO: 119 - DNA, 25 bp, Artificial Sequence
  probe sequence for 210434_x_at
ttgtcttgtcatcattcgtcagcga

SEQ ID NO: 120 - DNA, 25 bp, Artificial Sequence
  probe sequence for 210434_x_at
tcgagtccatatagctacattccac

SEQ ID NO: 121 - DNA, 25 bp, Artificial Sequence
  probe sequence for 210434_x_at
ccacccttgtatcctgggtcttaga

SEQ ID NO: 122 - DNA, 25 bp, Artificial Sequence
  probe sequence for 210434_x_at
tgatttgcactcttggttctttgga

SEQ ID NO: 123 - DNA, 25 bp, Artificial Sequence
  probe sequence for 209653_at
gtaattgatgccaatcttgtaccaa

SEQ ID NO: 124 - DNA, 25 bp, Artificial Sequence
  probe sequence for 209653_at
ggataagggggattttggcactcaa

SEQ ID NO: 125 - DNA, 25 bp, Artificial Sequence
  probe sequence for 209653_at
gaagctgcttgggccataagtaact

SEQ ID NO: 126 - DNA, 25 bp, Artificial Sequence
  probe sequence for 209653_at
gatcaagtggcttaccttatccaac

SEQ ID NO: 127 - DNA, 25 bp, Artificial Sequence
  probe sequence for 209653_at
tcccacctttttgcaacttgctgac

SEQ ID NO: 128 - DNA, 25 bp, Artificial Sequence
  probe sequence for 209653_at
gacatctacaaattggcctatgaga

SEQ ID NO: 129 - DNA, 25 bp, Artificial Sequence
  probe sequence for 209653_at
gatcattgatcagttcttctcttca

SEQ ID NO: 130 - DNA, 25 bp, Artificial Sequence
  probe sequence for 209653_at
gatattgatgaagaccctagccttg

SEQ ID NO: 131 - DNA, 25 bp, Artificial Sequence
  probe sequence for 209653_at
ccctagccttgttccagaggcaatt

SEQ ID NO: 132 - DNA, 25 bp, Artificial Sequence
  probe sequence for 209653_at
ggcggaacatttggtttcaattcat

SEQ ID NO: 133 - DNA, 25 bp, Artificial Sequence
  probe sequence for 209653_at
tcaattcatctgccaatgtaccaac

SEQ ID NO: 134 - DNA, 25 bp, Artificial Sequence
  probe sequence for 217949_s_at
gctattgttaggttgcctgcggaca

SEQ ID NO: 135 - DNA, 25 bp, Artificial Sequence
  probe sequence for 217949_s_at
tcttcgtgctctatgatttctgcat

SEQ ID NO: 136 - DNA, 25 bp, Artificial Sequence
  probe sequence for 217949_s_at
tctgcattgtttgtatcaccaccta

SEQ ID NO: 137 - DNA, 25 bp, Artificial Sequence
  probe sequence for 217949_s_at
accacctatgctatcaacgtgagcc

SEQ ID NO: 138 - DNA, 25 bp, Artificial Sequence
  probe sequence for 217949_s_at
gtggctcagtttccggaaggtccaa

SEQ ID NO: 139 - DNA, 25 bp, Artificial Sequence
  probe sequence for 217949_s_at
ggctaagaggcactgagccctcaac

SEQ ID NO: 140 - DNA, 25 bp, Artificial Sequence
  probe sequence for 217949_s_at
gcatgtgagccttgcctaagggggc

SEQ ID NO: 141 - DNA, 25 bp, Artificial Sequence
  probe sequence for 217949_s_at
gcctaagggggcatatctgggtccc

SEQ ID NO: 142 - DNA, 25 bp, Artificial Sequence
  probe sequence for 217949_s_at
tctgggtccctagaaggccctagat

SEQ ID NO: 143 - DNA, 25 bp, Artificial Sequence
  probe sequence for 217949_s_at
gatgtggggcttctagattaccccc

SEQ ID NO: 144 - DNA, 25 bp, Artificial Sequence
  probe sequence for 217949_s_at
ctgccatacccgcacatgacaatgg

SEQ ID NO: 145 - DNA, 25 bp, Artificial Sequence
  probe sequence for 203246_s_at
ttgtgacactggtgtccatcctcca

SEQ ID NO: 146 - DNA, 25 bp, Artificial Sequence
  probe sequence for 203246_s_at
gtactccaatgtatactgcccaacg

SEQ ID NO: 147 - DNA, 25 bp, Artificial Sequence
  probe sequence for 203246_s_at
agaggcatgtctatcctacgtgacc

SEQ ID NO: 148 - DNA, 25 bp, Artificial Sequence
  probe sequence for 203246_s_at
tctccgggatgtgttccagctatac

SEQ ID NO: 149 - DNA, 25 bp, Artificial Sequence
  probe sequence for 203246_s_at
gctgatccagttcgggcttatgaag

SEQ ID NO: 150 - DNA, 25 bp, Artificial Sequence
  probe sequence for 203246_s_at
gaagaacctcatcaggcgactacag

SEQ ID NO: 151 - DNA, 25 bp, Artificial Sequence
  probe sequence for 203246_s_at
gactcgggaagagcagagccaccct

SEQ ID NO: 152 - DNA, 25 bp, Artificial Sequence
  probe sequence for 203246_s_at
ggctttatacaggctgccacagcta

SEQ ID NO: 153 - DNA, 25 bp, Artificial Sequence
  probe sequence for 203246_s_at
gaaaatgaccccaacatcatcatct

SEQ ID NO: 154 - DNA, 25 bp, Artificial Sequence
  probe sequence for 203246_s_at
acacattgctgtgggtagtccctcc

SEQ ID NO: 155 - DNA, 25 bp, Artificial Sequence
  probe sequence for 203246_s_at
aggaggcttgtcatactgtctagag

SEQ ID NO: 156 - DNA, 25 bp, Artificial Sequence
  probe sequence for 219408_at
gctgtggttgtggagttcagggacc

SEQ ID NO: 157 - DNA, 25 bp, Artificial Sequence
  probe sequence for 219408_at
ctgtggtgactgcgaaggcttcgac

SEQ ID NO: 158 - DNA, 25 bp, Artificial Sequence
  probe sequence for 219408_at
gcttcgacgtgcacatcatggacga

SEQ ID NO: 159 - DNA, 25 bp, Artificial Sequence
  probe sequence for 219408_at
gacatgattaagcgtgccctggact

SEQ ID NO: 160 - DNA, 25 bp, Artificial Sequence
  probe sequence for 219408_at
ccctgtgtgccgagggcaccgtgga

SEQ ID NO: 161 - DNA, 25 bp, Artificial Sequence
  probe sequence for 219408_at
caccgtggagctcagaaggcccggg

SEQ ID NO: 162 - DNA, 25 bp, Artificial Sequence
  probe sequence for 219408_at
cagagccacgcagcggtgctatgga

SEQ ID NO: 163 - DNA, 25 bp, Artificial Sequence
  probe sequence for 219408_at
gccacgcagcggtgctatggatgga

SEQ ID NO: 164 - DNA, 25 bp, Artificial Sequence
  probe sequence for 219408_at
tatggatggagtaccacctgacccc

SEQ ID NO: 165 - DNA, 25 bp, Artificial Sequence
  probe sequence for 219408_at
ccagatcccagagcactgctgggtg

SEQ ID NO: 166 - DNA, 25 bp, Artificial Sequence
  probe sequence for 219408_at
ggagttcaggcatgcagatacccca

SEQ ID NO: 167 - DNA, 25 bp, Artificial Sequence
  probe sequence for 208682_s_at
gtacctggactatgccagagtcccc

SEQ ID NO: 168 - DNA, 25 bp, Artificial Sequence
  probe sequence for 208682_s_at
atgccagagtccccaatagcaatcc

SEQ ID NO: 169 - DNA, 25 bp, Artificial Sequence
  probe sequence for 208682_s_at
gcctgcgctcttactatgagaccag

SEQ ID NO: 170 - DNA, 25 bp, Artificial Sequence
  probe sequence for 208682_s_at
ggcagctcagtaccgagaggcgatg

SEQ ID NO: 171 - DNA, 25 bp, Artificial Sequence
  probe sequence for 208682_s_at
ggctgcagctgaagccaaggctagg

SEQ ID NO: 172 - DNA, 25 bp, Artificial Sequence
  probe sequence for 208682_s_at
agctcgaatgggcattgggctcggc

SEQ ID NO: 173 - DNA, 25 bp, Artificial Sequence
  probe sequence for 208682_s_at
ctgatatcggaccctgggccaaagc

SEQ ID NO: 174 - DNA, 25 bp, Artificial Sequence
  probe sequence for 208682_s_at
ccaaagcccggatccaggcgggagc

SEQ ID NO: 175 - DNA, 25 bp, Artificial Sequence
  probe sequence for 208682_s_at
gtaccaataacagtgccagtgccag

SEQ ID NO: 176 - DNA, 25 bp, Artificial Sequence
  probe sequence for 208682_s_at
agtgccagcaccagtggtggcttca

SEQ ID NO: 177 - DNA, 25 bp, Artificial Sequence
  probe sequence for 208682_s_at
caccagtggcagctctggtgcctgt

SEQ ID NO: 178 - DNA, 25 bp, Artificial Sequence
  probe sequence for 211609_x_at
tgggtcttggtgccagtgactttga

SEQ ID NO: 179 - DNA, 25 bp, Artificial Sequence
  probe sequence for 211609_x_at
gtagatcccagtgctgatcctgagc

SEQ ID NO: 180 - DNA, 25 bp, Artificial Sequence
  probe sequence for 211609_x_at
cagctgcagcttctgctgctgaggc

SEQ ID NO: 181 - DNA, 25 bp, Artificial Sequence
  probe sequence for 211609_x_at
gacgatgccctgctgaagatgacca

SEQ ID NO: 182 - DNA, 25 bp, Artificial Sequence
  probe sequence for 211609_x_at
agcaagagtttggccgcactgggct

SEQ ID NO: 183 - DNA, 25 bp, Artificial Sequence
  probe sequence for 211609_x_at
tgcttatgccatgcagatgtccctg

SEQ ID NO: 184 - DNA, 25 bp, Artificial Sequence
  probe sequence for 211609_x_at
gtttggccaggcggaatcagcagac

SEQ ID NO: 185 - DNA, 25 bp, Artificial Sequence
  probe sequence for 211609_x_at
tgccagctcagctatggacacatcc

SEQ ID NO: 186 - DNA, 25 bp, Artificial Sequence
  probe sequence for 211609_x_at
acacatccgagccagccaaggagga

SEQ ID NO: 187 - DNA, 25 bp, Artificial Sequence
  probe sequence for 211609_x_at
tgattacgacgtgatgcaggacccc

SEQ ID NO: 188 - DNA, 25 bp, Artificial Sequence
  probe sequence for 211609_x_at
gagttccttcagagtgtcctagaga

SEQ ID NO: 189 - DNA, 25 bp, Artificial Sequence
  probe sequence for 202936_s_at
gtagtgtatcactgagtcatttgca

SEQ ID NO: 190 - DNA, 25 bp, Artificial Sequence
  probe sequence for 202936_s_at
tgttttctgccacagacctttgggc

SEQ ID NO: 191 - DNA, 25 bp, Artificial Sequence
  probe sequence for 202936_s_at
tgggctgccttatattgtgtgtgtg

SEQ ID NO: 192 - DNA, 25 bp, Artificial Sequence
  probe sequence for 202936_s_at
aagcatgtgtcatccatatttctct

SEQ ID NO: 193 - DNA, 25 bp, Artificial Sequence
  probe sequence for 202936_s_at
ttggagtgagggaggctacctggag

SEQ ID NO: 194 - DNA, 25 bp, Artificial Sequence
  probe sequence for 202936_s_at
ctacctggaggggatcagcccactg

SEQ ID NO: 195 - DNA, 25 bp, Artificial Sequence
  probe sequence for 202936_s_at
cagcccactgacagaccttaatctt

SEQ ID NO: 196 - DNA, 25 bp, Artificial Sequence
  probe sequence for 202936_s_at
attactgctgtggctagagagtttg

SEQ ID NO: 197 - DNA, 25 bp, Artificial Sequence
  probe sequence for 202936_s_at
atatggcatccttcaatttctgtat

SEQ ID NO: 198 - DNA, 25 bp, Artificial Sequence
  probe sequence for 202936_s_at
gtaaaagctttggtttgtgttcgtg

SEQ ID NO: 199 - DNA, 25 bp, Artificial Sequence
  probe sequence for 202936_s_at
tgttctctccgtgaaacttaccttt

SEQ ID NO: 200 - DNA, 25 bp, Artificial Sequence
  probe sequence for 211954_s_at
gagccacaagcaggaagagcagcgc

SEQ ID NO: 201 - DNA, 25 bp, Artificial Sequence
  probe sequence for 211954_s_at
tttccatggatttctaccagaccac

SEQ ID NO: 202 - DNA, 25 bp, Artificial Sequence
  probe sequence for 211954_s_at
taccagaccactgaaggagttcctg

SEQ ID NO: 203 - DNA, 25 bp, Artificial Sequence
  probe sequence for 211954_s_at
gccctgcggtagctagcactgaaga

SEQ ID NO: 204 - DNA, 25 bp, Artificial Sequence
  probe sequence for 211954_s_at
tactcagcgtagatgtgtgttcaca

SEQ ID NO: 205 - DNA, 25 bp, Artificial Sequence
  probe sequence for 211954_s_at
gtgttcacacaaattgctctgcatt

SEQ ID NO: 206 - DNA, 25 bp, Artificial Sequence
  probe sequence for 211954_s_at
cctcctacccagcaaaccagtagac

SEQ ID NO: 207 - DNA, 25 bp, Artificial Sequence
  probe sequence for 211954_s_at
tttgatgtcactttggttctttttc

SEQ ID NO: 208 - DNA, 25 bp, Artificial Sequence
  probe sequence for 211954_s_at
agtgactcagtcgggaagctttcca

SEQ ID NO: 209 - DNA, 25 bp, Artificial Sequence
  probe sequence for 211954_s_at
gtgaagtgtcattggcatgtctggc

SEQ ID NO: 210 - DNA, 25 bp, Artificial Sequence
  probe sequence for 211954_s_at
atgtctggcagtagtctctcattca

SEQ ID NO: 211 - DNA, 25 bp, Artificial Sequence
  probe sequence for 213884_s_at
ggctgactggggcaacagccgcatc

SEQ ID NO: 212 - DNA, 25 bp, Artificial Sequence
  probe sequence for 213884_s_at
agccgcatccaggtattcgacagct

SEQ ID NO: 213 - DNA, 25 bp, Artificial Sequence
  probe sequence for 213884_s_at
ccaggtattcgacagctctggctcc

SEQ ID NO: 214 - DNA, 25 bp, Artificial Sequence
  probe sequence for 213884_s_at
ccttcctgtcctatatcaacacatc

SEQ ID NO: 215 - DNA, 25 bp, Artificial Sequence
  probe sequence for 213884_s_at
atcaacacatctgcagaaccactgt

SEQ ID NO: 216 - DNA, 25 bp, Artificial Sequence
  probe sequence for 213884_s_at
atctgcagaaccactgtatggtcca

SEQ ID NO: 217 - DNA, 25 bp, Artificial Sequence
  probe sequence for 213884_s_at
cactgacctcggatggccatgtggt

SEQ ID NO: 218 - DNA, 25 bp, Artificial Sequence
  probe sequence for 213884_s_at
tggtggctgatgctggcaaccactg

SEQ ID NO: 219 - DNA, 25 bp, Artificial Sequence
  probe sequence for 213884_s_at
accactgctttaaagcctatcgcta

SEQ ID NO: 220 - DNA, 25 bp, Artificial Sequence
  probe sequence for 213884_s_at
cctatcgctacctccagtagctgta

SEQ ID NO: 221 - DNA, 25 bp, Artificial Sequence
  probe sequence for 213884_s_at
tccagtagctgtacagaggccctgc

SEQ ID NO: 222 - DNA, 25 bp, Artificial Sequence
  probe sequence for 218976_at
cccaagcccctagagaagtcagtct

SEQ ID NO: 223 - DNA, 25 bp, Artificial Sequence
  probe sequence for 218976_at
agtctccccgcaaaattcagattct

SEQ ID NO: 224 - DNA, 25 bp, Artificial Sequence
  probe sequence for 218976_at
tgtgaatggttggcaccttcgtttc

SEQ ID NO: 225 - DNA, 25 bp, Artificial Sequence
  probe sequence for 218976_at
ctatgctgccaacatgcagtctttg

SEQ ID NO: 226 - DNA, 25 bp, Artificial Sequence
  probe sequence for 218976_at
catgtctgtgaattgctgagtacta

SEQ ID NO: 227 - DNA, 25 bp, Artificial Sequence
  probe sequence for 218976_at
tactaattgattcctccatccttga

SEQ ID NO: 228 - DNA, 25 bp, Artificial Sequence
  probe sequence for 218976_at
gaatcagttctcataatgcttttta

SEQ ID NO: 229 - DNA, 25 bp, Artificial Sequence
  probe sequence for 218976_at
atgctttttcctattaatactactt

SEQ ID NO: 230 - DNA, 25 bp, Artificial Sequence
  probe sequence for 218976_at
attgacatactgtgatctctattag

SEQ ID NO: 231 - DNA, 25 bp, Artificial Sequence
  probe sequence for 218976_at
tgttttcttacccttgacttacaat

SEQ ID NO: 232 - DNA, 25 bp, Artificial Sequence
  probe sequence for 218976_at
gtgaaattacttgtctgaaccccgt

SEQ ID NO: 233 - DNA, 25 bp, Artificial Sequence
  probe sequence for 204288_s_at
aaaggtgctgaggactaccctgacc

SEQ ID NO: 234 - DNA, 25 bp, Artificial Sequence
  probe sequence for 204288_s_at
gataggattcacagcttgagctcaa

SEQ ID NO: 235 - DNA, 25 bp, Artificial Sequence
  probe sequence for 204288_s_at
gagctcaaataagccacagcgtcct

SEQ ID NO: 236 - DNA, 25 bp, Artificial Sequence
  probe sequence for 204288_s_at
agcgtcctgtgtttactcatgaaaa

SEQ ID NO: 237 - DNA, 25 bp, Artificial Sequence
  probe sequence for 204288_s_at
ggctctgtataactatactcccagg

SEQ ID NO: 238 - DNA, 25 bp, Artificial Sequence
  probe sequence for 204288_s_at
gtgatgacggctggtttgtggggac

SEQ ID NO: 239 - DNA, 25 bp, Artificial Sequence
  probe sequence for 204288_s_at
tccccggaaactacgtcaagaggct

SEQ ID NO: 240 - DNA, 25 bp, Artificial Sequence
  probe sequence for 204288_s_at
aagaggctgtgaattgcgctccctc

SEQ ID NO: 241 - DNA, 25 bp, Artificial Sequence
  probe sequence for 204288_s_at
tcccgttgtcatgccttacggtttc

SEQ ID NO: 242 - DNA, 25 bp, Artificial Sequence
  probe sequence for 204288_s_at
gggacgacatggcaggctggtcccc

SEQ ID NO: 243 - DNA, 25 bp, Artificial Sequence
  probe sequence for 204288_s_at
gaaagtgtggattcctacttcctgc

SEQ ID NO: 244 - DNA, 25 bp, Artificial Sequence
  probe sequence for 202355_s_at
gagagcgacattgacagcgaggcct

SEQ ID NO: 245 - DNA, 25 bp, Artificial Sequence
  probe sequence for 202355_s_at
gagcggaagccgtcgggagggagct

SEQ ID NO: 246 - DNA, 25 bp, Artificial Sequence
  probe sequence for 202355_s_at
gcagccaagcggttgcggctggaca

SEQ ID NO: 247 - DNA, 25 bp, Artificial Sequence
  probe sequence for 202355_s_at
agagcctgtctgggaagtcgacacc

SEQ ID NO: 248 - DNA, 25 bp, Artificial Sequence
  probe sequence for 202355_s_at
ccaccatcaggcaagacaacaccca

SEQ ID NO: 249 - DNA, 25 bp, Artificial Sequence
  probe sequence for 202355_s_at
gcaggtgactgaggatgccgtgcgc

SEQ ID NO: 250 - DNA, 25 bp, Artificial Sequence
  probe sequence for 202355_s_at
agcccatgaccactaaggacctgct

SEQ ID NO: 251 - DNA, 25 bp, Artificial Sequence
  probe sequence for 202355_s_at
gacagtgaacgtgttggcccagatc

SEQ ID NO: 252 - DNA, 25 bp, Artificial Sequence
  probe sequence for 202355_s_at
caaccccgagcgcaagatgatcaac

SEQ ID NO: 253 - DNA, 25 bp, Artificial Sequence
  probe sequence for 202355_s_at
tcaacgacaaaatgcacttctccct

SEQ ID NO: 254 - DNA, 25 bp, Artificial Sequence
  probe sequence for 202355_s_at
gcttggtccaatacatggctctgcc

SEQ ID NO: 255 - DNA, 25 bp, Artificial Sequence
  probe sequence for 212932_at
tttagacttgcaggtgccttttcat

SEQ ID NO: 256 - DNA, 25 bp, Artificial Sequence
  probe sequence for 212932_at
gattcttctagcattactcgttggt

SEQ ID NO: 257 - DNA, 25 bp, Artificial Sequence
  probe sequence for 212932_at
ggccctgtccagttgggtgatcagg

SEQ ID NO: 258 - DNA, 25 bp, Artificial Sequence
  probe sequence for 212932_at
accagcatcggaaagacttcccagc

SEQ ID NO: 259 - DNA, 25 bp, Artificial Sequence
  probe sequence for 212932_at
agcaccaagcttgagctgtgtcgtt

SEQ ID NO: 260 - DNA, 25 bp, Artificial Sequence
  probe sequence for 212932_at
tgtgtcgtttcgtggagggggcagc

SEQ ID NO: 261 - DNA, 25 bp, Artificial Sequence
  probe sequence for 212932_at
ggggcagcgaggatgggcttgagct

SEQ ID NO: 262 - DNA, 25 bp, Artificial Sequence
  probe sequence for 212932_at
gagctgttgagagatttctgcccta

SEQ ID NO: 263 - DNA, 25 bp, Artificial Sequence
  probe sequence for 212932_at
ttctgccctagagatggcctttgta

SEQ ID NO: 264 - DNA, 25 bp, Artificial Sequence
  probe sequence for 212932_at
actggcaggacggtgttcatcgcat

SEQ ID NO: 265 - DNA, 25 bp, Artificial Sequence
  probe sequence for 212932_at
gaccagcctctaggctagcggctgc

SEQ ID NO: 266 - DNA, 25 bp, Artificial Sequence
  probe sequence for 212041_at
gtgtcgcaacatcgtgtggatcgct

SEQ ID NO: 267 - DNA, 25 bp, Artificial Sequence
  probe sequence for 212041_at
gtggatcgctgaatgtatcgcccag

SEQ ID NO: 268 - DNA, 25 bp, Artificial Sequence
  probe sequence for 212041_at
caccgcgccaaaatcgacaactaca

SEQ ID NO: 269 - DNA, 25 bp, Artificial Sequence
  probe sequence for 212041_at
aaatcgacaactacatccctatctt

SEQ ID NO: 270 - DNA, 25 bp, Artificial Sequence
  probe sequence for 212041_at
ggctctcaattgcactctttgtgtg

SEQ ID NO: 271 - DNA, 25 bp, Artificial Sequence
  probe sequence for 212041_at
gtgtatgtggtctgtgacaagcctg

SEQ ID NO: 272 - DNA, 25 bp, Artificial Sequence
  probe sequence for 212041_at
ctgtgacaagcctgtggctcacctg

SEQ ID NO: 273 - DNA, 25 bp, Artificial Sequence
  probe sequence for 212041_at
caccaaggatggacgaagaccccct

SEQ ID NO: 274 - DNA, 25 bp, Artificial Sequence
  probe sequence for 212041_at
tcagccctgtggttacagccgctga

SEQ ID NO: 275 - DNA, 25 bp, Artificial Sequence
  probe sequence for 212041_at
acagccgctgatgtatctaagaagc

SEQ ID NO: 276 - DNA, 25 bp, Artificial Sequence
  probe sequence for 212041_at
ccctgcccctctgagacaataaaac

SEQ ID NO: 277 - DNA, 25 bp, Artificial Sequence
  probe sequence for 221932_s_at
agcagagagggagccgttcatgtca

SEQ ID NO: 278 - DNA, 25 bp, Artificial Sequence
  probe sequence for 221932_s_at
gttcatgtcagagactcactgccag

SEQ ID NO: 279 - DNA, 25 bp, Artificial Sequence
  probe sequence for 221932_s_at
cactgccagaaaagccttacccatt

SEQ ID NO: 280 - DNA, 25 bp, Artificial Sequence
  probe sequence for 221932_s_at
ttgagaccgcaactgcttgcactga

SEQ ID NO: 281 - DNA, 25 bp, Artificial Sequence
  probe sequence for 221932_s_at
ttttagttggtctggtgttcgggct

SEQ ID NO: 282 - DNA, 25 bp, Artificial Sequence
  probe sequence for 221932_s_at
gtcacttattctttgcctgattcag

SEQ ID NO: 283 - DNA, 25 bp, Artificial Sequence
  probe sequence for 221932_s_at
gaatcattattcatgacccctctgc

SEQ ID NO: 284 - DNA, 25 bp, Artificial Sequence
  probe sequence for 221932_s_at
gacccctctgcaaatgtgtcagtct

SEQ ID NO: 285 - DNA, 25 bp, Artificial Sequence
  probe sequence for 221932_s_at
gtctccaaagagagtatctcccccc

SEQ ID NO: 286 - DNA, 25 bp, Artificial Sequence
  probe sequence for 221932_s_at
atctccccccaaattttgtgtagct

SEQ ID NO: 287 - DNA, 25 bp, Artificial Sequence
  probe sequence for 221932_s_at
tgtgcatgcctgagttgattccgaa

SEQ ID NO: 288 - DNA, 25 bp, Artificial Sequence
  probe sequence for 215208_x_at
gtccaggctaaggtgcaatggcacg

SEQ ID NO: 289 - DNA, 25 bp, Artificial Sequence
  probe sequence for 215208_x_at
gtgcaatggcacgatggctcacgcc

SEQ ID NO: 290 - DNA, 25 bp, Artificial Sequence
  probe sequence for 215208_x_at
gctactggggaagctgaggttgcag

SEQ ID NO: 291 - DNA, 25 bp, Artificial Sequence
  probe sequence for 215208_x_at
gggcaacagagcaacactttgtcaa

SEQ ID NO: 292 - DNA, 25 bp, Artificial Sequence
  probe sequence for 215208_x_at
gtctacagcataaacatctttaggc

SEQ ID NO: 293 - DNA, 25 bp, Artificial Sequence
  probe sequence for 215208_x_at
aaaaactaattttggcctggtgcag

SEQ ID NO: 294 - DNA, 25 bp, Artificial Sequence
  probe sequence for 215208_x_at
cctggtgcagtgacttgcgctataa

SEQ ID NO: 295 - DNA, 25 bp, Artificial Sequence
  probe sequence for 215208_x_at
gtgacttgcgctataatcccagcac

SEQ ID NO: 296 - DNA, 25 bp, Artificial Sequence
  probe sequence for 215208_x_at
agaccagagtgaccaacactgtgaa

SEQ ID NO: 297 - DNA, 25 bp, Artificial Sequence
  probe sequence for 215208_x_at
cccacctcactcggaggctgaggca

SEQ ID NO: 298 - DNA, 25 bp, Artificial Sequence
  probe sequence for 215208_x_at
tgaacccgggaagcagagattacag

SEQ ID NO: 299 - DNA, 25 bp, Artificial Sequence
  probe sequence for 205684_s_at
gaagtaactcttggggacaatatat

SEQ ID NO: 300 - DNA, 25 bp, Artificial Sequence
  probe sequence for 205684_s_at
gcattaccttgaaatatgaagtgcc

SEQ ID NO: 301 - DNA, 25 bp, Artificial Sequence
  probe sequence for 205684_s_at
agtgccatttgaatgtcccagggct

SEQ ID NO: 302 - DNA, 25 bp, Artificial Sequence
  probe sequence for 205684_s_at
gccatttgaatgtcccagggcttat

SEQ ID NO: 303 - DNA, 25 bp, Artificial Sequence
  probe sequence for 205684_s_at
ttgaatgtcccagggcttattaata

SEQ ID NO: 304 - DNA, 25 bp, Artificial Sequence
  probe sequence for 205684_s_at
aagattttcaacccctgaactgctt

SEQ ID NO: 305 - DNA, 25 bp, Artificial Sequence
  probe sequence for 205684_s_at
tctgcctctgtggaaaactactttg

SEQ ID NO: 306 - DNA, 25 bp, Artificial Sequence
  probe sequence for 205684_s_at
gaaaactactttgggattcttcagt

SEQ ID NO: 307 - DNA, 25 bp, Artificial Sequence
  probe sequence for 205684_s_at
tactttgggattcttcagtatttgt

SEQ ID NO: 308 - DNA, 25 bp, Artificial Sequence
  probe sequence for 205684_s_at
attcattctaggcattgtttatatt

SEQ ID NO: 309 - DNA, 25 bp, Artificial Sequence
  probe sequence for 205684_s_at
ctaggcattgtttatatttgaagtt

SEQ ID NO: 310 - DNA, 25 bp, Artificial Sequence
  probe sequence for 208082_x_at
ccttggtttaaggctgggcgcggtg

SEQ ID NO: 311 - DNA, 25 bp, Artificial Sequence
  probe sequence for 208082_x_at
gcggccggatcacaaggccaggaga

SEQ ID NO: 312 - DNA, 25 bp, Artificial Sequence
  probe sequence for 208082_x_at
atcgagaccatcctgtgaatggcga

SEQ ID NO: 313 - DNA, 25 bp, Artificial Sequence
  probe sequence for 208082_x_at
tgtgaatggcgaaaccctgtctcta

SEQ ID NO: 314 - DNA, 25 bp, Artificial Sequence
  probe sequence for 208082_x_at
gaggcggagcttgcaatgaactgag

SEQ ID NO: 315 - DNA, 25 bp, Artificial Sequence
  probe sequence for 208082_x_at
ctgagaatgtgccactggactccca

SEQ ID NO: 316 - DNA, 25 bp, Artificial Sequence
  probe sequence for 208082_x_at
tatagcagtactagctctgtttata

SEQ ID NO: 317 - DNA, 25 bp, Artificial Sequence
  probe sequence for 208082_x_at
aaactacctggttatcccatatatt

SEQ ID NO: 318 - DNA, 25 bp, Artificial Sequence
  probe sequence for 208082_x_at
aatgttttacgatctagcctttcca

SEQ ID NO: 319 - DNA, 25 bp, Artificial Sequence
  probe sequence for 208082_x_at
gcctttccagtataggcacttcctg

SEQ ID NO: 320 - DNA, 25 bp, Artificial Sequence
  probe sequence for 208082_x_at
gcacttcctgaaaaacctttgtcct

SEQ ID NO: 321 - DNA, 25 bp, Artificial Sequence
  probe sequence for 214153_at
ttgttgccagtgcctggtagccata

SEQ ID NO: 322 - DNA, 25 bp, Artificial Sequence
  probe sequence for 214153_at
gtagccataaggcctgctgatctgg

SEQ ID NO: 323 - DNA, 25 bp, Artificial Sequence
  probe sequence for 214153_at
aagtcatatacttctgggcttcata

SEQ ID NO: 324 - DNA, 25 bp, Artificial Sequence
  probe sequence for 214153_at
gggcttcatagtttatggctgcact

SEQ ID NO: 325 - DNA, 25 bp, Artificial Sequence
  probe sequence for 214153_at
atggctgcactgtgggacatacacc

SEQ ID NO: 326 - DNA, 25 bp, Artificial Sequence
  probe sequence for 214153_at
gggacatacaccagctacaaggaag

SEQ ID NO: 327 - DNA, 25 bp, Artificial Sequence
  probe sequence for 214153_at
ggataggacccgatgaagctgaaat

SEQ ID NO: 328 - DNA, 25 bp, Artificial Sequence
  probe sequence for 214153_at
cttatagcagcatagcactttgttc

SEQ ID NO: 329 - DNA, 25 bp, Artificial Sequence
  probe sequence for 214153_at
gaaagaccaatttggccacataacc

SEQ ID NO: 330 - DNA, 25 bp, Artificial Sequence
  probe sequence for 214153_at
cctgtcatctgccatccagatacta

SEQ ID NO: 331 - DNA, 25 bp, Artificial Sequence
  probe sequence for 214153_at
gcctgtgattcagttaacttacctc

SEQ ID NO: 332 - DNA, 25 bp, Artificial Sequence
  probe sequence for 210556_at
ggtaagttcatctctgatatgttct

SEQ ID NO: 333 - DNA, 25 bp, Artificial Sequence
  probe sequence for 210556_at
gttcatctctgatatgttcttgaag

SEQ ID NO: 334 - DNA, 25 bp, Artificial Sequence
  probe sequence for 210556_at
atctctgatatgttcttgaagtagt

SEQ ID NO: 335 - DNA, 25 bp, Artificial Sequence
  probe sequence for 210556_at
gattcagggactttattctcccaag

SEQ ID NO: 336 - DNA, 25 bp, Artificial Sequence
  probe sequence for 210556_at
tcagggactttattctcccaagtgt

SEQ ID NO: 337 - DNA, 25 bp, Artificial Sequence
  probe sequence for 210556_at
gactttattctcccaagtgtcatga

SEQ ID NO: 338 - DNA, 25 bp, Artificial Sequence
  probe sequence for 210556_at
agtttctatggattgcttattggca

SEQ ID NO: 339 - DNA, 25 bp, Artificial Sequence
  probe sequence for 210556_at
tattggcatatggttgggcttttaa

SEQ ID NO: 340 - DNA, 25 bp, Artificial Sequence
  probe sequence for 210556_at
aatatataactttgccaggtaccac

SEQ ID NO: 341 - DNA, 25 bp, Artificial Sequence
  probe sequence for 210556_at
taactttgccaggtaccacggctca

SEQ ID NO: 342 - DNA, 25 bp, Artificial Sequence
  probe sequence for 210556_at
aggtggcagttgcagggagctaaga

SEQ ID NO: 343 - DNA, 25 bp, Artificial Sequence
  probe sequence for 217679_x_at
gcactttgggaagctgaggcggtgg

SEQ ID NO: 344 - DNA, 25 bp, Artificial Sequence
  probe sequence for 217679_x_at
actttgggaagctgaggcggtggat

SEQ ID NO: 345 - DNA, 25 bp, Artificial Sequence
  probe sequence for 217679_x_at
ctttgggaagctgaggcggtggatc

SEQ ID NO: 346 - DNA, 25 bp, Artificial Sequence
  probe sequence for 217679_x_at
ttgggaagctgaggcggtggatcac

SEQ ID NO: 347 - DNA, 25 bp, Artificial Sequence
  probe sequence for 217679_x_at
tgggaagctgaggcggtggatcacc

SEQ ID NO: 348 - DNA, 25 bp, Artificial Sequence
  probe sequence for 217679_x_at
ctgaggcggtggatcacctgagctc

SEQ ID NO: 349 - DNA, 25 bp, Artificial Sequence
  probe sequence for 217679_x_at
tgaggcggtggatcacctgagctca

SEQ ID NO: 350 - DNA, 25 bp, Artificial Sequence
  probe sequence for 217679_x_at
cctgggcgacaaagcaagactcttt

SEQ ID NO: 351 - DNA, 25 bp, Artificial Sequence
  probe sequence for 217679_x_at
ctgggcgacaaagcaagactctttc

SEQ ID NO: 352 - DNA, 25 bp, Artificial Sequence
  probe sequence for 217679_x_at
tgggcgacaaagcaagactctttct

SEQ ID NO: 353 - DNA, 25 bp, Artificial Sequence
  probe sequence for 217679_x_at
gagacagaaaagatgggtttttgtt

SEQ ID NO: 354 - DNA, 25 bp, Artificial Sequence
  probe sequence for 207730_x_at
tcaaggggttgctcagatgggccgg

SEQ ID NO: 355 - DNA, 25 bp, Artificial Sequence
  probe sequence for 207730_x_at
tgctcagatgggccgggcatggtgg

SEQ ID NO: 356 - DNA, 25 bp, Artificial Sequence
  probe sequence for 207730_x_at
gtaacctcagcactgtgggaggcca

SEQ ID NO: 357 - DNA, 25 bp, Artificial Sequence
  probe sequence for 207730_x_at
ggaggccaagggggcagatcacttc

SEQ ID NO: 358 - DNA, 25 bp, Artificial Sequence
  probe sequence for 207730_x_at
agatcacttcaggtcgggagttcca

SEQ ID NO: 359 - DNA, 25 bp, Artificial Sequence
  probe sequence for 207730_x_at
cagaccagcctgttcaacatggcga

SEQ ID NO: 360 - DNA, 25 bp, Artificial Sequence
  probe sequence for 207730_x_at
caacatggcgaaaccccattctacc

SEQ ID NO: 361 - DNA, 25 bp, Artificial Sequence
  probe sequence for 207730_x_at
gactgaggaggggtcacctgaggtc

SEQ ID NO: 362 - DNA, 25 bp, Artificial Sequence
  probe sequence for 207730_x_at
ggatgtcaagatcagactggccaac

SEQ ID NO: 363 - DNA, 25 bp, Artificial Sequence
  probe sequence for 207730_x_at
gccaacagaatgaaaccctgtctct

SEQ ID NO: 364 - DNA, 25 bp, Artificial Sequence
  probe sequence for 207730_x_at
agaaagttagccgggcgtggcacct

SEQ ID NO: 365 - DNA, 25 bp, Artificial Sequence
  probe sequence for 214800_x_at
gcaaactgaattgagtcaacttctg

SEQ ID NO: 366 - DNA, 25 bp, Artificial Sequence
  probe sequence for 214800_x_at
agaagttactgggagctgctatttt

SEQ ID NO: 367 - DNA, 25 bp, Artificial Sequence
  probe sequence for 214800_x_at
agatctctaatatttttaagcccaa

SEQ ID NO: 368 - DNA, 25 bp, Artificial Sequence
  probe sequence for 214800_x_at
cttggacactgcagctcttttcagt

SEQ ID NO: 369 - DNA, 25 bp, Artificial Sequence
  probe sequence for 214800_x_at
ctcttttcagtttttgcttatacac

SEQ ID NO: 370 - DNA, 25 bp, Artificial Sequence
  probe sequence for 214800_x_at
acacaattcattctttgcagctaat

SEQ ID NO: 371 - DNA, 25 bp, Artificial Sequence
  probe sequence for 214800_x_at
ttaagccgaagaagcctgggaatca

SEQ ID NO: 372 - DNA, 25 bp, Artificial Sequence
  probe sequence for 214800_x_at
gttctttgcctagtatacagtttta

SEQ ID NO: 373 - DNA, 25 bp, Artificial Sequence
  probe sequence for 214800_x_at
tttatttcattgacaccgatctgta

SEQ ID NO: 374 - DNA, 25 bp, Artificial Sequence
  probe sequence for 214800_x_at
cattgacaccgatctgtacacagta

SEQ ID NO: 375 - DNA, 25 bp, Artificial Sequence
  probe sequence for 214800_x_at
aatatggctgataacctttggaatt

SEQ ID NO: 376 - DNA, 25 bp, Artificial Sequence
  probe sequence for 202901_x_at
gattaatgtgtatttactgtactaa

SEQ ID NO: 377 - DNA, 25 bp, Artificial Sequence
  probe sequence for 202901_x_at
aatatagtttgaggccgggcacggt

SEQ ID NO: 378 - DNA, 25 bp, Artificial Sequence
  probe sequence for 202901_x_at
tatagtttgattcttcattttttta

SEQ ID NO: 379 - DNA, 25 bp, Artificial Sequence
  probe sequence for 202901_x_at
aatctcaggataaagtttgctaagt

SEQ ID NO: 380 - DNA, 25 bp, Artificial Sequence
  probe sequence for 202901_x_at
gttcaacctaaaacaatctgtaatt

SEQ ID NO: 381 - DNA, 25 bp, Artificial Sequence
  probe sequence for 202901_x_at
atctgtaattgcttattgttttatt

SEQ ID NO: 382 - DNA, 25 bp, Artificial Sequence
  probe sequence for 202901_x_at
tttattgtatactctttgtctttta

SEQ ID NO: 383 - DNA, 25 bp, Artificial Sequence
  probe sequence for 202901_x_at
tgtcttttaagacccctaatagcct

SEQ ID NO: 384 - DNA, 25 bp, Artificial Sequence
  probe sequence for 202901_x_at
ccctaatagccttttgtaacttgat

SEQ ID NO: 385 - DNA, 25 bp, Artificial Sequence
  probe sequence for 202901_x_at
gccttttgtaacttgatggcttaaa

SEQ ID NO: 386 - DNA, 25 bp, Artificial Sequence
  probe sequence for 202901_x_at
aaaaatacttaataaatctgccatt

SEQ ID NO: 387 - DNA, 25 bp, Artificial Sequence
  probe sequence for 220856_x_at
taaaagcacagacttcaggccaggc

SEQ ID NO: 388 - DNA, 25 bp, Artificial Sequence
  probe sequence for 220856_x_at
ttcaggccaggcacaatgactcaca

SEQ ID NO: 389 - DNA, 25 bp, Artificial Sequence
  probe sequence for 220856_x_at
gggctgattcagccccaggagttca

SEQ ID NO: 390 - DNA, 25 bp, Artificial Sequence
  probe sequence for 220856_x_at
attagccggcagtggtggcacatgc

SEQ ID NO: 391 - DNA, 25 bp, Artificial Sequence
  probe sequence for 220856_x_at
cagtcccagctactcgagaggatga

SEQ ID NO: 392 - DNA, 25 bp, Artificial Sequence
  probe sequence for 220856_x_at
ccagctgggcatggtgactcacact

SEQ ID NO: 393 - DNA, 25 bp, Artificial Sequence
  probe sequence for 220856_x_at
gccaaggagggcaggtcatgaggtc

SEQ ID NO: 394 - DNA, 25 bp, Artificial Sequence
  probe sequence for 220856_x_at
ggccaatttgtacctgcaggcctcc

SEQ ID NO: 395 - DNA, 25 bp, Artificial Sequence
  probe sequence for 220856_x_at
tcgaccgcgatgatgtggctctgga

SEQ ID NO: 396 - DNA, 25 bp, Artificial Sequence
  probe sequence for 220856_x_at
tctggaaggcgtgagccacttcttc

SEQ ID NO: 397 - DNA, 25 bp, Artificial Sequence
  probe sequence for 220856_x_at
cttcttccgcgaattggccgaggag

SEQ ID NO: 398 - DNA, 25 bp, Artificial Sequence
  probe sequence for 208137_x_at
gagttcaagcctttattgacattca

SEQ ID NO: 399 - DNA, 25 bp, Artificial Sequence
  probe sequence for 208137_x_at
aagaggatggggccaggtgtggtgg

SEQ ID NO: 400 - DNA, 25 bp, Artificial Sequence
  probe sequence for 208137_x_at
cacgtcgggaggccaaggcacatag

SEQ ID NO: 401 - DNA, 25 bp, Artificial Sequence
  probe sequence for 208137_x_at
ggcacataggtcacttgaggtcagg

SEQ ID NO: 402 - DNA, 25 bp, Artificial Sequence
  probe sequence for 208137_x_at
accagcatggccaacagatgtgagc

SEQ ID NO: 403 - DNA, 25 bp, Artificial Sequence
  probe sequence for 208137_x_at
agatgtgagccacttttctcagcct

SEQ ID NO: 404 - DNA, 25 bp, Artificial Sequence
  probe sequence for 208137_x_at
ttctcagcctgttttttgtttctta

SEQ ID NO: 405 - DNA, 25 bp, Artificial Sequence
  probe sequence for 208137_x_at
gatatgaggccaggcacggaggctc

SEQ ID NO: 406 - DNA, 25 bp, Artificial Sequence
  probe sequence for 208137_x_at
gagactttcctggctaacagggtga

SEQ ID NO: 407 - DNA, 25 bp, Artificial Sequence
  probe sequence for 208137_x_at
gtcccagctactccagatgctgagg

SEQ ID NO: 408 - DNA, 25 bp, Artificial Sequence
  probe sequence for 208137_x_at
ttgcagggagtcgagatcgcgccac

SEQ ID NO: 409 - DNA, 25 bp, Artificial Sequence
  probe sequence for 215620_at
agacatccctccttgttatgtctta

SEQ ID NO: 410 - DNA, 25 bp, Artificial Sequence
  probe sequence for 215620_at
ccctccttgttatgtcttactttgt

SEQ ID NO: 411 - DNA, 25 bp, Artificial Sequence
  probe sequence for 215620_at
ttatgtcttactttgttgctgttgc

SEQ ID NO: 412 - DNA, 25 bp, Artificial Sequence
  probe sequence for 215620_at
ctctactccgactgcagttgtagaa

SEQ ID NO: 413 - DNA, 25 bp, Artificial Sequence
  probe sequence for 215620_at
ggcagagaaggtatgacaccccctc

SEQ ID NO: 414 - DNA, 25 bp, Artificial Sequence
  probe sequence for 215620_at
tcccccattatacctcagaaagaac

SEQ ID NO: 415 - DNA, 25 bp, Artificial Sequence
  probe sequence for 215620_at
tgagtacgactgggaatttgttttt

SEQ ID NO: 416 - DNA, 25 bp, Artificial Sequence
  probe sequence for 215620_at
tttgttttttccactatctctagga

SEQ ID NO: 417 - DNA, 25 bp, Artificial Sequence
  probe sequence for 215620_at
gttttgtagaatccatatccttaat

SEQ ID NO: 418 - DNA, 25 bp, Artificial Sequence
  probe sequence for 215620_at
agagcatacctagttctcagaccca

SEQ ID NO: 419 - DNA, 25 bp, Artificial Sequence
  probe sequence for 215620_at
gttctcagacccaattccatagatt

SEQ ID NO: 420 - DNA, 25 bp, Artificial Sequence
  probe sequence for 221648_s_at
gcagctgggctcttaatgttactta

SEQ ID NO: 421 - DNA, 25 bp, Artificial Sequence
  probe sequence for 221648_s_at
acttattgtaactcacttcctgtaa

SEQ ID NO: 422 - DNA, 25 bp, Artificial Sequence
  probe sequence for 221648_s_at
gtaagactcaatctactcttcaagt

SEQ ID NO: 423 - DNA, 25 bp, Artificial Sequence
  probe sequence for 221648_s_at
tcttcaagttgatgtaccctctatg

SEQ ID NO: 424 - DNA, 25 bp, Artificial Sequence
  probe sequence for 221648_s_at
gtaccctctatgactgtaattcctg

SEQ ID NO: 425 - DNA, 25 bp, Artificial Sequence
  probe sequence for 221648_s_at
ctgtggtgatcttaagcgtgtcttg

SEQ ID NO: 426 - DNA, 25 bp, Artificial Sequence
  probe sequence for 221648_s_at
gcgtgtcttgagttccatgcaaatt

SEQ ID NO: 427 - DNA, 25 bp, Artificial Sequence
  probe sequence for 221648_s_at
gtgtccataatcaaatcatcatctt

SEQ ID NO: 428 - DNA, 25 bp, Artificial Sequence
  probe sequence for 221648_s_at
aagggctaccccataattatcagac

SEQ ID NO: 429 - DNA, 25 bp, Artificial Sequence
  probe sequence for 221648_s_at
tctttttccattctgtaatcttaaa

SEQ ID NO: 430 - DNA, 25 bp, Artificial Sequence
  probe sequence for 221648_s_at
tcagcttcagtgcctgttcacaata

SEQ ID NO: 431 - DNA, 25 bp, Artificial Sequence
  probe sequence for 215001_s_at
ggctggtcaacttgagcatgttact

SEQ ID NO: 432 - DNA, 25 bp, Artificial Sequence
  probe sequence for 215001_s_at
atagcatgtcactaaagcaggcctt

SEQ ID NO: 433 - DNA, 25 bp, Artificial Sequence
  probe sequence for 215001_s_at
acagaattgcttgtttgcttcaact

SEQ ID NO: 434 - DNA, 25 bp, Artificial Sequence
  probe sequence for 215001_s_at
acagggctggagtcaaaacacttgt

SEQ ID NO: 435 - DNA, 25 bp, Artificial Sequence
  probe sequence for 215001_s_at
attttctggttcttgtgttggctgt

SEQ ID NO: 436 - DNA, 25 bp, Artificial Sequence
  probe sequence for 215001_s_at
gttcttgtgttggctgtggcaggcc

SEQ ID NO: 437 - DNA, 25 bp, Artificial Sequence
  probe sequence for 215001_s_at
tttcttttgccatgacaacttctaa

SEQ ID NO: 438 - DNA, 25 bp, Artificial Sequence
  probe sequence for 215001_s_at
gacaacttctaattgccatgtacag

SEQ ID NO: 439 - DNA, 25 bp, Artificial Sequence
  probe sequence for 215001_s_at
gtcaaataactcctcattgtaaaca

SEQ ID NO: 440 - DNA, 25 bp, Artificial Sequence
  probe sequence for 215001_s_at
acaaactgtgtaactgcccaaagca

SEQ ID NO: 441 - DNA, 25 bp, Artificial Sequence
  probe sequence for 215001_s_at
gcagcacttataaatcagcctaaca

SEQ ID NO: 442 - DNA, 25 bp, Artificial Sequence
  probe sequence for 222168_at
aattcacttattttcatgggttctg

SEQ ID NO: 443 - DNA, 25 bp, Artificial Sequence
  probe sequence for 222168_at
gacctaaaaatctcaatggcaccta

SEQ ID NO: 444 - DNA, 25 bp, Artificial Sequence
  probe sequence for 222168_at
ctaaaaatctcaatggcacctacca

SEQ ID NO: 445 - DNA, 25 bp, Artificial Sequence
  probe sequence for 222168_at
ctaacacatagtaggggctctacat

SEQ ID NO: 446 - DNA, 25 bp, Artificial Sequence
  probe sequence for 222168_at
gtaggggctctacatgattatctgt

SEQ ID NO: 447 - DNA, 25 bp, Artificial Sequence
  probe sequence for 222168_at
ggctctacatgattatctgtaattg

SEQ ID NO: 448 - DNA, 25 bp, Artificial Sequence
  probe sequence for 222168_at
ggaggtgatggttttcctatttgat

SEQ ID NO: 449 - DNA, 25 bp, Artificial Sequence
  probe sequence for 222168_at
gcaacatagttctaagccagtggtt

SEQ ID NO: 450 - DNA, 25 bp, Artificial Sequence
  probe sequence for 222168_at
tggttctccaacttgagtatgcatc

SEQ ID NO: 451 - DNA, 25 bp, Artificial Sequence
  probe sequence for 222168_at
tctccaacttgagtatgcatcagaa

SEQ ID NO: 452 - DNA, 25 bp, Artificial Sequence
  probe sequence for 222168_at
aaaatacagatgtctgccgggcgcg

SEQ ID NO: 453 - DNA, 25 bp, Artificial Sequence
  probe sequence for 212297_at
gttccccatgtttatgaaagtcctg

SEQ ID NO: 454 - DNA, 25 bp, Artificial Sequence
  probe sequence for 212297_at
aaatattcatgcatgcaattttgac

SEQ ID NO: 455 - DNA, 25 bp, Artificial Sequence
  probe sequence for 212297_at
tgtatatttatggtgggaggtggtt

SEQ ID NO: 456 - DNA, 25 bp, Artificial Sequence
  probe sequence for 212297_at
aatttttgtacagtctgtgggcatt

SEQ ID NO: 457 - DNA, 25 bp, Artificial Sequence
  probe sequence for 212297_at
gtctgtgggcatttacacattttta

SEQ ID NO: 458 - DNA, 25 bp, Artificial Sequence
  probe sequence for 212297_at
aagttacttctagttatgatttgtg

SEQ ID NO: 459 - DNA, 25 bp, Artificial Sequence
  probe sequence for 212297_at
gatttgtgaattccctaagaccttg

SEQ ID NO: 460 - DNA, 25 bp, Artificial Sequence
  probe sequence for 212297_at
aatgatactgcatctttatattttt

SEQ ID NO: 461 - DNA, 25 bp, Artificial Sequence
  probe sequence for 212297_at
aaattgtattgctgctcaagaatgg

SEQ ID NO: 462 - DNA, 25 bp, Artificial Sequence
  probe sequence for 212297_at
agaatggtaccctcttgtcaaaaag

SEQ ID NO: 463 - DNA, 25 bp, Artificial Sequence
  probe sequence for 212297_at
cattcataattgtacattcagcatt

SEQ ID NO: 464 - DNA, 25 bp, Artificial Sequence
  probe sequence for 215604_x_at
gaacccaggaagcggaagttgcagt

SEQ ID NO: 465 - DNA, 25 bp, Artificial Sequence
  probe sequence for 215604_x_at
gacagagggagactccgtctccaaa

SEQ ID NO: 466 - DNA, 25 bp, Artificial Sequence
  probe sequence for 215604_x_at
aaagttcaggccgggcacggtagct

SEQ ID NO: 467 - DNA, 25 bp, Artificial Sequence
  probe sequence for 215604_x_at
ggctgatgcaggtggatcaccggag

SEQ ID NO: 468 - DNA, 25 bp, Artificial Sequence
  probe sequence for 215604_x_at
caccggaggtcaggaactagaaatc

SEQ ID NO: 469 - DNA, 25 bp, Artificial Sequence
  probe sequence for 215604_x_at
ggaactagaaatcagcctggccaac

SEQ ID NO: 470 - DNA, 25 bp, Artificial Sequence
  probe sequence for 215604_x_at
ttagacaggtgtggtggtgcgtgcc

SEQ ID NO: 471 - DNA, 25 bp, Artificial Sequence
  probe sequence for 215604_x_at
gaagcagaaaaatcacttgaaccca

SEQ ID NO: 472 - DNA, 25 bp, Artificial Sequence
  probe sequence for 215604_x_at
tgagatcgtgccattgcattccagc

SEQ ID NO: 473 - DNA, 25 bp, Artificial Sequence
  probe sequence for 215604_x_at
cgacaagactgaaactctatccccc

SEQ ID NO: 474 - DNA, 25 bp, Artificial Sequence
  probe sequence for 215604_x_at
taagaaactatattaccagagcaag

SEQ ID NO: 475 - DNA, 25 bp, Artificial Sequence
  probe sequence for 209770_at
ggaaatttggatgaagggagctaga

SEQ ID NO: 476 - DNA, 25 bp, Artificial Sequence
  probe sequence for 209770_at
agtacagatgagggttcactatgtt

SEQ ID NO: 477 - DNA, 25 bp, Artificial Sequence
  probe sequence for 209770_at
caccgggtgaccggcttacagggat

SEQ ID NO: 478 - DNA, 25 bp, Artificial Sequence
  probe sequence for 209770_at
tgaccggcttacagggatattttta

SEQ ID NO: 479 - DNA, 25 bp, Artificial Sequence
  probe sequence for 209770_at
ttaatcccgttatggactctgtctc

SEQ ID NO: 480 - DNA, 25 bp, Artificial Sequence
  probe sequence for 209770_at
gtctccaggagaggggtctatccac

SEQ ID NO: 481 - DNA, 25 bp, Artificial Sequence
  probe sequence for 209770_at
ctatccacccctgctcattggtgga

SEQ ID NO: 482 - DNA, 25 bp, Artificial Sequence
  probe sequence for 209770_at
ccacccctgctcattggtggatgtt

SEQ ID NO: 483 - DNA, 25 bp, Artificial Sequence
  probe sequence for 209770_at
ggaaaaactactcctcattatcatc

SEQ ID NO: 484 - DNA, 25 bp, Artificial Sequence
  probe sequence for 209770_at
atcattattattgctctccactgta

SEQ ID NO: 485 - DNA, 25 bp, Artificial Sequence
  probe sequence for 209770_at
ctctacctggcatgtgcttgtcaag

SEQ ID NO: 486 - DNA, 25 bp, Artificial Sequence
  probe sequence for 205010_at
gctctggcatctgccctgaaaaata

SEQ ID NO: 487 - DNA, 25 bp, Artificial Sequence
  probe sequence for 205010_at
gaaacgtgcagataaaatcgccagc

SEQ ID NO: 488 - DNA, 25 bp, Artificial Sequence
  probe sequence for 205010_at
agataaaatcgccagcaagctgtct

SEQ ID NO: 489 - DNA, 25 bp, Artificial Sequence
  probe sequence for 205010_at
atcgccagcaagctgtctgattcca

SEQ ID NO: 490 - DNA, 25 bp, Artificial Sequence
  probe sequence for 205010_at
gatggtgttggtgactaatcgactg

SEQ ID NO: 491 - DNA, 25 bp, Artificial Sequence
  probe sequence for 205010_at
ggtgttggtgactaatcgactgatc

SEQ ID NO: 492 - DNA, 25 bp, Artificial Sequence
  probe sequence for 205010_at
gtgactaatcgactgatctcacttc

SEQ ID NO: 493 - DNA, 25 bp, Artificial Sequence
  probe sequence for 205010_at
ccaagcaccagttccggtggtacgg

SEQ ID NO: 494 - DNA, 25 bp, Artificial Sequence
  probe sequence for 205010_at
gtacgggggaataccagtgaaatag

SEQ ID NO: 495 - DNA, 25 bp, Artificial Sequence
  probe sequence for 205010_at
aagcatctgcatattgaaagaacgc

SEQ ID NO: 496 - DNA, 25 bp, Artificial Sequence
  probe sequence for 205010_at
attgaaagaacgctttccccactgt

SEQ ID NO: 497 - DNA, 25 bp, Artificial Sequence
  probe sequence for 215179_x_at
gaccaacacggtgaaaccacatctc

SEQ ID NO: 498 - DNA, 25 bp, Artificial Sequence
  probe sequence for 215179_x_at
attagctgggcgtgttggtgcatgc

SEQ ID NO: 499 - DNA, 25 bp, Artificial Sequence
  probe sequence for 215179_x_at
aagaattccaaaagcccatgtgctc

SEQ ID NO: 500 - DNA, 25 bp, Artificial Sequence
  probe sequence for 215179_x_at
cccttgcccattcttaagttgacat

SEQ ID NO: 501 - DNA, 25 bp, Artificial Sequence
  probe sequence for 215179_x_at
agtcaagccaggctcagtacctcat

SEQ ID NO: 502 - DNA, 25 bp, Artificial Sequence
  probe sequence for 215179_x_at
agtacctcatgcctgtaattctagc

SEQ ID NO: 503 - DNA, 25 bp, Artificial Sequence
  probe sequence for 215179_x_at
cgagtggatcgcttgaggccaggag

SEQ ID NO: 504 - DNA, 25 bp, Artificial Sequence
  probe sequence for 215179_x_at
ccaggagttcaagcctagccggggc

SEQ ID NO: 505 - DNA, 25 bp, Artificial Sequence
  probe sequence for 215179_x_at
gccggggcaacatggcgaaacctcg

SEQ ID NO: 506 - DNA, 25 bp, Artificial Sequence
  probe sequence for 215179_x_at
actagctggacgtggtgccatgtgc

SEQ ID NO: 507 - DNA, 25 bp, Artificial Sequence
  probe sequence for 215179_x_at
gtggaatgatcacctgagcctggga

SEQ ID NO: 508 - DNA, 25 bp, Artificial Sequence
  probe sequence for 212052_s_at
gctgccttagacagattccctgggc

SEQ ID NO: 509 - DNA, 25 bp, Artificial Sequence
  probe sequence for 212052_s_at
caccttccttacacctggtgggagc

SEQ ID NO: 510 - DNA, 25 bp, Artificial Sequence
  probe sequence for 212052_s_at
tatgtggtatgggggtcattcctgc

SEQ ID NO: 511 - DNA, 25 bp, Artificial Sequence
  probe sequence for 212052_s_at
aagtgatggaaccctcaggtgctct

SEQ ID NO: 512 - DNA, 25 bp, Artificial Sequence
  probe sequence for 212052_s_at
agcctgaacctcctgactgaggaac

SEQ ID NO: 513 - DNA, 25 bp, Artificial Sequence
  probe sequence for 212052_s_at
cacaggcgtggctgtacacgtgctc

SEQ ID NO: 514 - DNA, 25 bp, Artificial Sequence
  probe sequence for 212052_s_at
ctcatcatcctttccagtaacttta

SEQ ID NO: 515 - DNA, 25 bp, Artificial Sequence
  probe sequence for 212052_s_at
aaaaaacatccctcaggtcctgata

SEQ ID NO: 516 - DNA, 25 bp, Artificial Sequence
  probe sequence for 212052_s_at
ggtcctgatatatttccttggattc

SEQ ID NO: 517 - DNA, 25 bp, Artificial Sequence
  probe sequence for 212052_s_at
ttggctagaaattacactgtgctca

SEQ ID NO: 518 - DNA, 25 bp, Artificial Sequence
  probe sequence for 212052_s_at
tgtgctcaatgccttaataaatccc

SEQ ID NO: 519 - DNA, 25 bp, Artificial Sequence
  probe sequence for 216859_x_at
ccaacagctcactgagaacgggtca

SEQ ID NO: 520 - DNA, 25 bp, Artificial Sequence
  probe sequence for 216859_x_at
acagctcactgagaacgggtcatga

SEQ ID NO: 521 - DNA, 25 bp, Artificial Sequence
  probe sequence for 216859_x_at
agctcactgagaacgggtcatgatg

SEQ ID NO: 522 - DNA, 25 bp, Artificial Sequence
  probe sequence for 216859_x_at
cactgagaacgggtcatgatgacga

SEQ ID NO: 523 - DNA, 25 bp, Artificial Sequence
  probe sequence for 216859_x_at
gagaaatcagattgttgctgtgtct

SEQ ID NO: 524 - DNA, 25 bp, Artificial Sequence
  probe sequence for 216859_x_at
gattgttgctgtgtctgtgtagaaa

SEQ ID NO: 525 - DNA, 25 bp, Artificial Sequence
  probe sequence for 216859_x_at
gaagtagacacaggagactccactt

SEQ ID NO: 526 - DNA, 25 bp, Artificial Sequence
  probe sequence for 216859_x_at
gacacaggagactccactttgttct

SEQ ID NO: 527 - DNA, 25 bp, Artificial Sequence
  probe sequence for 216859_x_at
acaggagactccactttgttctgta

SEQ ID NO: 528 - DNA, 25 bp, Artificial Sequence
  probe sequence for 216859_x_at
agacctctgttcacttgtttatttg

SEQ ID NO: 529 - DNA, 25 bp, Artificial Sequence
  probe sequence for 216859_x_at
tctgttcacttgtttatttgctgac

SEQ ID NO: 530 - DNA, 25 bp, Artificial Sequence
  probe sequence for 204205_at
gcccgcatctatgatgatcaaggaa

SEQ ID NO: 531 - DNA, 25 bp, Artificial Sequence
  probe sequence for 204205_at
aagatgtcaggaggggctgcgcacc

SEQ ID NO: 532 - DNA, 25 bp, Artificial Sequence
  probe sequence for 204205_at
accagcaaagcaatgcactcctgac

SEQ ID NO: 533 - DNA, 25 bp, Artificial Sequence
  probe sequence for 204205_at
gcaatgcactcctgaccaagtagat

SEQ ID NO: 534 - DNA, 25 bp, Artificial Sequence
  probe sequence for 204205_at
gcactcctgaccaagtagattcttt

SEQ ID NO: 535 - DNA, 25 bp, Artificial Sequence
  probe sequence for 204205_at
attagagtgcattactttgaatcaa

SEQ ID NO: 536 - DNA, 25 bp, Artificial Sequence
  probe sequence for 204205_at
taaagtactaagattgtgctcaata

SEQ ID NO: 537 - DNA, 25 bp, Artificial Sequence
  probe sequence for 204205_at
gtttcaaacctactaatccagcgac

SEQ ID NO: 538 - DNA, 25 bp, Artificial Sequence
  probe sequence for 204205_at
aaacctactaatccagcgacaattt

SEQ ID NO: 539 - DNA, 25 bp, Artificial Sequence
  probe sequence for 204205_at
atccagcgacaatttgaatcggttt

SEQ ID NO: 540 - DNA, 25 bp, Artificial Sequence
  probe sequence for 204205_at
gaatcggttttgtaggtagaggaat

SEQ ID NO: 541 - DNA, 25 bp, Artificial Sequence
  probe sequence for 217588_at
cgtcgacgtaagcacttctcagaga

SEQ ID NO: 542 - DNA, 25 bp, Artificial Sequence
  probe sequence for 217588_at
tgggtgccttggggtgtattttact

SEQ ID NO: 543 - DNA, 25 bp, Artificial Sequence
  probe sequence for 217588_at
aacctgtgtgttttccacagtccct

SEQ ID NO: 544 - DNA, 25 bp, Artificial Sequence
  probe sequence for 217588_at
ctgcttcccgaggttgtggtattgg

SEQ ID NO: 545 - DNA, 25 bp, Artificial Sequence
  probe sequence for 217588_at
ggtaggggtaacaggccaatcggtg

SEQ ID NO: 546 - DNA, 25 bp, Artificial Sequence
  probe sequence for 217588_at
caggccaatcggtgtggcttcagct

SEQ ID NO: 547 - DNA, 25 bp, Artificial Sequence
  probe sequence for 217588_at
tctctcaaactccttgcacaattcc

SEQ ID NO: 548 - DNA, 25 bp, Artificial Sequence
  probe sequence for 217588_at
actccttgcacaattccgtcaaatt

SEQ ID NO: 549 - DNA, 25 bp, Artificial Sequence
  probe sequence for 217588_at
ttattttggtcctggtcagggccct

SEQ ID NO: 550 - DNA, 25 bp, Artificial Sequence
  probe sequence for 217588_at
cagggccctcaaggtgatttgactg

SEQ ID NO: 551 - DNA, 25 bp, Artificial Sequence
  probe sequence for 217588_at
gccgagggggatgggtcatgaggtc

SEQ ID NO: 552 - DNA, 25 bp, Artificial Sequence
  probe sequence for 218155_at
aaccacaacattgcctgcatgtcta

SEQ ID NO: 553 - DNA, 25 bp, Artificial Sequence
  probe sequence for 218155_at
caacattgcctgcatgtctaaaaga

SEQ ID NO: 554 - DNA, 25 bp, Artificial Sequence
  probe sequence for 218155_at
gcctggccaacctggtgaaatgcag

SEQ ID NO: 555 - DNA, 25 bp, Artificial Sequence
  probe sequence for 218155_at
acctggtgaaatgcagtgtcaacta

SEQ ID NO: 556 - DNA, 25 bp, Artificial Sequence
  probe sequence for 218155_at
aataggaaaatcagccaggcgtggt

SEQ ID NO: 557 - DNA, 25 bp, Artificial Sequence
  probe sequence for 218155_at
gaatcacttgaacttgggaggggta

SEQ ID NO: 558 - DNA, 25 bp, Artificial Sequence
  probe sequence for 218155_at
aacttgggaggggtaggttgcagtg

SEQ ID NO: 559 - DNA, 25 bp, Artificial Sequence
  probe sequence for 218155_at
tgggaggggtaggttgcagtgagct

SEQ ID NO: 560 - DNA, 25 bp, Artificial Sequence
  probe sequence for 218155_at
gctgagatcacaccaaaatggggtg

SEQ ID NO: 561 - DNA, 25 bp, Artificial Sequence
  probe sequence for 218155_at
caaaatggggtggggcgcagtggct

SEQ ID NO: 562 - DNA, 25 bp, Artificial Sequence
  probe sequence for 218155_at
ggcggatcacgaggtagggagatca

SEQ ID NO: 563 - DNA, 25 bp, Artificial Sequence
  probe sequence for 208082_x_at
ccttggtttaaggctgggcgcggtg

SEQ ID NO: 564 - DNA, 25 bp, Artificial Sequence
  probe sequence for 208082_x_at
gcggccggatcacaaggccaggaga

SEQ ID NO: 565 - DNA, 25 bp, Artificial Sequence
  probe sequence for 208082_x_at
atcgagaccatcctgtgaatggcga

SEQ ID NO: 566 - DNA, 25 bp, Artificial Sequence
  probe sequence for 208082_x_at
tgtgaatggcgaaaccctgtctcta

SEQ ID NO: 567 - DNA, 25 bp, Artificial Sequence
  probe sequence for 208082_x_at
gaggcggagcttgcaatgaactgag

SEQ ID NO: 568 - DNA, 25 bp, Artificial Sequence
  probe sequence for 208082_x_at
ctgagaatgtgccactggactccca

SEQ ID NO: 569 - DNA, 25 bp, Artificial Sequence
  probe sequence for 208082_x_at
tatagcagtactagctctgtttata

SEQ ID NO: 570 - DNA, 25 bp, Artificial Sequence
  probe sequence for 208082_x_at
aaactacctggttatcccatatatt

SEQ ID NO: 571 - DNA, 25 bp, Artificial Sequence
  probe sequence for 208082_x_at
aatgttttacgatctagcctttcca

SEQ ID NO: 572 - DNA, 25 bp, Artificial Sequence
  probe sequence for 208082_x_at
gcctttccagtataggcacttcctg

SEQ ID NO: 573 - DNA, 25 bp, Artificial Sequence
  probe sequence for 208082_x_at
gcacttcctgaaaaacctttgtcct

SEQ ID NO: 574 - DNA, 25 bp, Artificial Sequence
  probe sequence for 214800_x_at
gcaaactgaattgagtcaacttctg

SEQ ID NO: 575 - DNA, 25 bp, Artificial Sequence
  probe sequence for 214800_x_at
agaagttactgggagctgctatttt

SEQ ID NO: 576 - DNA, 25 bp, Artificial Sequence
  probe sequence for 214800_x_at
agatctctaatatttttaagcccaa

SEQ ID NO: 577 - DNA, 25 bp, Artificial Sequence
  probe sequence for 214800_x_at
cttggacactgcagctcttttcagt

SEQ ID NO: 578 - DNA, 25 bp, Artificial Sequence
  probe sequence for 214800_x_at
ctcttttcagtttttgcttatacac

SEQ ID NO: 579 - DNA, 25 bp, Artificial Sequence
  probe sequence for 214800_x_at
acacaattcattctttgcagctaat

SEQ ID NO: 580 - DNA, 25 bp, Artificial Sequence
  probe sequence for 214800_x_at
ttaagccgaagaagcctgggaatca

SEQ ID NO: 581 - DNA, 25 bp, Artificial Sequence
  probe sequence for 214800_x_at
gttctttgcctagtatacagtttta

SEQ ID NO: 582 - DNA, 25 bp, Artificial Sequence
  probe sequence for 214800_x_at
tttatttcattgacaccgatctgta

SEQ ID NO: 583 - DNA, 25 bp, Artificial Sequence
  probe sequence for 214800_x_at
cattgacaccgatctgtacacagta

SEQ ID NO: 584 - DNA, 25 bp, Artificial Sequence
  probe sequence for 214800_x_at
aatatggctgataacctttggaatt

SEQ ID NO: 585 - DNA, 25 bp, Artificial Sequence
  probe sequence for 215208_x_at
gtccaggctaaggtgcaatggcacg

SEQ ID NO: 586 - DNA, 25 bp, Artificial Sequence
  probe sequence for 215208_x_at
gtgcaatggcacgatggctcacgcc

SEQ ID NO: 587 - DNA, 25 bp, Artificial Sequence
  probe sequence for 215208_x_at
gctactggggaagctgaggttgcag

SEQ ID NO: 588 - DNA, 25 bp, Artificial Sequence
  probe sequence for 215208_x_at
gggcaacagagcaacactttgtcaa

SEQ ID NO: 589 - DNA, 25 bp, Artificial Sequence
  probe sequence for 215208_x_at
gtctacagcataaacatctttaggc

SEQ ID NO: 590 - DNA, 25 bp, Artificial Sequence
  probe sequence for 215208_x_at
aaaaactaattttggcctggtgcag

SEQ ID NO: 591 - DNA, 25 bp, Artificial Sequence
  probe sequence for 215208_x_at
cctggtgcagtgacttgcgctataa

SEQ ID NO: 592 - DNA, 25 bp, Artificial Sequence
  probe sequence for 215208_x_at
gtgacttgcgctataatcccagcac

SEQ ID NO: 593 - DNA, 25 bp, Artificial Sequence
  probe sequence for 215208_x_at
agaccagagtgaccaacactgtgaa

SEQ ID NO: 594 - DNA, 25 bp, Artificial Sequence
  probe sequence for 215208_x_at
cccacctcactcggaggctgaggca

SEQ ID NO: 595 - DNA, 25 bp, Artificial Sequence
  probe sequence for 215208_x_at
tgaacccgggaagcagagattacag

SEQ ID NO: 596 - DNA, 25 bp, Artificial Sequence
  probe sequence for 218556_at
tagccggacggggatctgagctggc

SEQ ID NO: 597 - DNA, 25 bp, Artificial Sequence
  probe sequence for 218556_at
taaaccccaacacccgagtgatgaa

SEQ ID NO: 598 - DNA, 25 bp, Artificial Sequence
  probe sequence for 218556_at
tgcatatggttctactcagcatccc

SEQ ID NO: 599 - DNA, 25 bp, Artificial Sequence
  probe sequence for 218556_at
cttcagcattcctgttgtctggacc

SEQ ID NO: 600 - DNA, 25 bp, Artificial Sequence
  probe sequence for 218556_at
ctgaccaacgtcatccataacctgg

SEQ ID NO: 601 - DNA, 25 bp, Artificial Sequence
  probe sequence for 218556_at
taacctggctacgtatgtcttcctt

SEQ ID NO: 602 - DNA, 25 bp, Artificial Sequence
  probe sequence for 218556_at
aaggaaaggctcggctactgacaca

SEQ ID NO: 603 - DNA, 25 bp, Artificial Sequence
  probe sequence for 218556_at
tggactatgggctccagtttacctc

SEQ ID NO: 604 - DNA, 25 bp, Artificial Sequence
  probe sequence for 218556_at
tcctggccagcttctataccaagta

SEQ ID NO: 605 - DNA, 25 bp, Artificial Sequence
  probe sequence for 218556_at
gcctcattgctaagtgtactgctgc

SEQ ID NO: 606 - DNA, 25 bp, Artificial Sequence
  probe sequence for 218556_at
gttccatggggttcgtgtctttggc

SEQ ID NO: 607 - DNA, 25 bp, Artificial Sequence
  probe sequence for 207730_x_at
tcaaggggttgctcagatgggccgg

SEQ ID NO: 608 - DNA, 25 bp, Artificial Sequence
  probe sequence for 207730_x_at
tgctcagatgggccgggcatggtgg

SEQ ID NO: 609 - DNA, 25 bp, Artificial Sequence
  probe sequence for 207730_x_at
gtaacctcagcactgtgggaggcca

SEQ ID NO: 610 - DNA, 25 bp, Artificial Sequence
  probe sequence for 207730_x_at
ggaggccaagggggcagatcacttc

SEQ ID NO: 611 - DNA, 25 bp, Artificial Sequence
  probe sequence for 207730_x_at
agatcacttcaggtcgggagttcca

SEQ ID NO: 612 - DNA, 25 bp, Artificial Sequence
  probe sequence for 207730_x_at
cagaccagcctgttcaacatggcga

SEQ ID NO: 613 - DNA, 25 bp, Artificial Sequence
  probe sequence for 207730_x_at
caacatggcgaaaccccattctacc

SEQ ID NO: 614 - DNA, 25 bp, Artificial Sequence
  probe sequence for 207730_x_at
gactgaggaggggtcacctgaggtc

SEQ ID NO: 615 - DNA, 25 bp, Artificial Sequence
  probe sequence for 207730_x_at
ggatgtcaagatcagactggccaac

SEQ ID NO: 616 - DNA, 25 bp, Artificial Sequence
  probe sequence for 207730_x_at
gccaacagaatgaaaccctgtctct

SEQ ID NO: 617 - DNA, 25 bp, Artificial Sequence
  probe sequence for 207730_x_at
agaaagttagccgggcgtggcacct

SEQ ID NO: 618 - DNA, 25 bp, Artificial Sequence
  probe sequence for 210556_at
ggtaagttcatctctgatatgttct

SEQ ID NO: 619 - DNA, 25 bp, Artificial Sequence
  probe sequence for 210556_at
gttcatctctgatatgttcttgaag

SEQ ID NO: 620 - DNA, 25 bp, Artificial Sequence
  probe sequence for 210556_at
atctctgatatgttcttgaagtagt

SEQ ID NO: 621 - DNA, 25 bp, Artificial Sequence
  probe sequence for 210556_at
gattcagggactttattctcccaag

SEQ ID NO: 622 - DNA, 25 bp, Artificial Sequence
  probe sequence for 210556_at
tcagggactttattctcccaagtgt

SEQ ID NO: 623 - DNA, 25 bp, Artificial Sequence
  probe sequence for 210556_at
gactttattctcccaagtgtcatga

SEQ ID NO: 624 - DNA, 25 bp, Artificial Sequence
  probe sequence for 210556_at
agtttctatggattgcttattggca

SEQ ID NO: 625 - DNA, 25 bp, Artificial Sequence
  probe sequence for 210556_at
tattggcatatggttgggcttttaa

SEQ ID NO: 626 - DNA, 25 bp, Artificial Sequence
  probe sequence for 210556_at
aatatataactttgccaggtaccac

SEQ ID NO: 627 - DNA, 25 bp, Artificial Sequence
  probe sequence for 210556_at
taactttgccaggtaccacggctca

SEQ ID NO: 628 - DNA, 25 bp, Artificial Sequence
  probe sequence for 210556_at
aggtggcagttgcagggagctaaga

SEQ ID NO: 629 - DNA, 25 bp, Artificial Sequence
  probe sequence for 203588_s_at
tctaccattcagctgccattcataa

SEQ ID NO: 630 - DNA, 25 bp, Artificial Sequence
  probe sequence for 203588_s_at
gcagcatctccagtgacaagtttga

SEQ ID NO: 631 - DNA, 25 bp, Artificial Sequence
  probe sequence for 203588_s_at
atgggaatgtcgtttggcctggagt

SEQ ID NO: 632 - DNA, 25 bp, Artificial Sequence
  probe sequence for 203588_s_at
ggagtcaggcaaatgctctctggag

SEQ ID NO: 633 - DNA, 25 bp, Artificial Sequence
  probe sequence for 203588_s_at
tgaaacttgcgaaatccctggtgcc

SEQ ID NO: 634 - DNA, 25 bp, Artificial Sequence
  probe sequence for 203588_s_at
atatctccacaggaccttcttggtt

SEQ ID NO: 635 - DNA, 25 bp, Artificial Sequence
  probe sequence for 203588_s_at
tcagggactacttctgaactctacc

SEQ ID NO: 636 - DNA, 25 bp, Artificial Sequence
  probe sequence for 203588_s_at
aatttagacctgaccactggtgcca

SEQ ID NO: 637 - DNA, 25 bp, Artificial Sequence
  probe sequence for 203588_s_at
agtggccttagcaactgggcagttc

SEQ ID NO: 638 - DNA, 25 bp, Artificial Sequence
  probe sequence for 203588_s_at
caaacagtcaccagtccagcagtgc

SEQ ID NO: 639 - DNA, 25 bp, Artificial Sequence
  probe sequence for 203588_s_at
attcctcctccccagaataaagaca

SEQ ID NO: 640 - DNA, 25 bp, Artificial Sequence
  probe sequence for 217679_x_at
gcactttgggaagctgaggcggtgg

SEQ ID NO: 641 - DNA, 25 bp, Artificial Sequence
  probe sequence for 217679_x_at
actttgggaagctgaggcggtggat

SEQ ID NO: 642 - DNA, 25 bp, Artificial Sequence
  probe sequence for 217679_x_at
ctttgggaagctgaggcggtggatc

SEQ ID NO: 643 - DNA, 25 bp, Artificial Sequence
  probe sequence for 217679_x_at
ttgggaagctgaggcggtggatcac

SEQ ID NO: 644 - DNA, 25 bp, Artificial Sequence
  probe sequence for 217679_x_at
tgggaagctgaggcggtggatcacc

SEQ ID NO: 645 - DNA, 25 bp, Artificial Sequence
  probe sequence for 217679_x_at
ctgaggcggtggatcacctgagctc

SEQ ID NO: 646 - DNA, 25 bp, Artificial Sequence
  probe sequence for 217679_x_at
tgaggcggtggatcacctgagctca

SEQ ID NO: 647 - DNA, 25 bp, Artificial Sequence
  probe sequence for 217679_x_at
cctgggcgacaaagcaagactcttt

SEQ ID NO: 648 - DNA, 25 bp, Artificial Sequence
  probe sequence for 217679_x_at
ctgggcgacaaagcaagactctttc

SEQ ID NO: 649 - DNA, 25 bp, Artificial Sequence
  probe sequence for 217679_x_at
tgggcgacaaagcaagactctttct

SEQ ID NO: 650 - DNA, 25 bp, Artificial Sequence
  probe sequence for 217679_x_at
gagacagaaaagatgggtttttgtt

SEQ ID NO: 651 - DNA, 25 bp, Artificial Sequence
  probe sequence for 202901_x_at
gattaatgtgtatttactgtactaa

SEQ ID NO: 652 - DNA, 25 bp, Artificial Sequence
  probe sequence for 202901_x_at
aatatagtttgaggccgggcacggt

SEQ ID NO: 653 - DNA, 25 bp, Artificial Sequence
  probe sequence for 202901_x_at
tatagtttgattcttcattttttta

SEQ ID NO: 654 - DNA, 25 bp, Artificial Sequence
  probe sequence for 202901_x_at
aatctcaggataaagtttgctaagt

SEQ ID NO: 655 - DNA, 25 bp, Artificial Sequence
  probe sequence for 202901_x_at
gttcaacctaaaacaatctgtaatt

SEQ ID NO: 656 - DNA, 25 bp, Artificial Sequence
  probe sequence for 202901_x_at
atctgtaattgcttattgttttatt

SEQ ID NO: 657 - DNA, 25 bp, Artificial Sequence
  probe sequence for 202901_x_at
tttattgtatactctttgtctttta

SEQ ID NO: 658 - DNA, 25 bp, Artificial Sequence
  probe sequence for 202901_x_at
tgtcttttaagacccctaatagcct

SEQ ID NO: 659 - DNA, 25 bp, Artificial Sequence
  probe sequence for 202901_x_at
ccctaatagccttttgtaacttgat

SEQ ID NO: 660 - DNA, 25 bp, Artificial Sequence
  probe sequence for 202901_x_at
gccttttgtaacttgatggcttaaa

SEQ ID NO: 661 - DNA, 25 bp, Artificial Sequence
  probe sequence for 202901_x_at
aaaaatacttaataaatctgccatt

SEQ ID NO: 662 - DNA, 25 bp, Artificial Sequence
  probe sequence for 213939_s_at
gtcacgtcgcaagtccgatatcaca

SEQ ID NO: 663 - DNA, 25 bp, Artificial Sequence
  probe sequence for 213939_s_at
gttactacatttaagctctgattct

SEQ ID NO: 664 - DNA, 25 bp, Artificial Sequence
  probe sequence for 213939_s_at
aacccagtccttgataataccagat

SEQ ID NO: 665 - DNA, 25 bp, Artificial Sequence
  probe sequence for 213939_s_at
gattctcggtgcattgttcatgtct

SEQ ID NO: 666 - DNA, 25 bp, Artificial Sequence
  probe sequence for 213939_s_at
gttcatgtctgtatctgcaagcctg

SEQ ID NO: 667 - DNA, 25 bp, Artificial Sequence
  probe sequence for 213939_s_at
tctgccattgcagtgtgatgaacct

SEQ ID NO: 668 - DNA, 25 bp, Artificial Sequence
  probe sequence for 213939_s_at
aactaccatgtgaacttgaactctt

SEQ ID NO: 669 - DNA, 25 bp, Artificial Sequence
  probe sequence for 213939_s_at
tctgtgtctcttagaccatgacccc

SEQ ID NO: 670 - DNA, 25 bp, Artificial Sequence
  probe sequence for 213939_s_at
atataggtttaatccccaagccaag

SEQ ID NO: 671 - DNA, 25 bp, Artificial Sequence
  probe sequence for 213939_s_at
agtatttcactacacttctattctc

SEQ ID NO: 672 - DNA, 25 bp, Artificial Sequence
  probe sequence for 213939_s_at
gattgcttgcaactttttttgcctt

SEQ ID NO: 673 - DNA, 25 bp, Artificial Sequence
  probe sequence for 208137_x_at
gagttcaagcctttattgacattca

SEQ ID NO: 674 - DNA, 25 bp, Artificial Sequence
  probe sequence for 208137_x_at
aagaggatggggccaggtgtggtgg

SEQ ID NO: 675 - DNA, 25 bp, Artificial Sequence
  probe sequence for 208137_x_at
cacgtcgggaggccaaggcacatag

SEQ ID NO: 676 - DNA, 25 bp, Artificial Sequence
  probe sequence for 208137_x_at
ggcacataggtcacttgaggtcagg

SEQ ID NO: 677 - DNA, 25 bp, Artificial Sequence
  probe sequence for 208137_x_at
accagcatggccaacagatgtgagc

SEQ ID NO: 678 - DNA, 25 bp, Artificial Sequence
  probe sequence for 208137_x_at
agatgtgagccacttttctcagcct

SEQ ID NO: 679 - DNA, 25 bp, Artificial Sequence
  probe sequence for 208137_x_at
ttctcagcctgttttttgtttctta

SEQ ID NO: 680 - DNA, 25 bp, Artificial Sequence
  probe sequence for 208137_x_at
gatatgaggccaggcacggaggctc

SEQ ID NO: 681 - DNA, 25 bp, Artificial Sequence
  probe sequence for 208137_x_at
gagactttcctggctaacagggtga

SEQ ID NO: 682 - DNA, 25 bp, Artificial Sequence
  probe sequence for 208137_x_at
gtcccagctactccagatgctgagg

SEQ ID NO: 683 - DNA, 25 bp, Artificial Sequence
  probe sequence for 208137_x_at
ttgcagggagtcgagatcgcgccac

SEQ ID NO: 684 - DNA, 25 bp, Artificial Sequence
  probe sequence for 214705_at
aacaactagcaaggttctttcactt

SEQ ID NO: 685 - DNA, 25 bp, Artificial Sequence
  probe sequence for 214705_at
ggttctttcacttggaattactaag

SEQ ID NO: 686 - DNA, 25 bp, Artificial Sequence
  probe sequence for 214705_at
ggaattactaagatcggagttttgc

SEQ ID NO: 687 - DNA, 25 bp, Artificial Sequence
  probe sequence for 214705_at
tgattaaagcaaccatacccaagaa

SEQ ID NO: 688 - DNA, 25 bp, Artificial Sequence
  probe sequence for 214705_at
atacccaagaaatagctagcatcaa

SEQ ID NO: 689 - DNA, 25 bp, Artificial Sequence
  probe sequence for 214705_at
gaatgagatttatccaatgttgggt

SEQ ID NO: 690 - DNA, 25 bp, Artificial Sequence
  probe sequence for 214705_at
gggtcaagaacattgcttcgacatg

SEQ ID NO: 691 - DNA, 25 bp, Artificial Sequence
  probe sequence for 214705_at
gaacattgcttcgacatggaaatta

SEQ ID NO: 692 - DNA, 25 bp, Artificial Sequence
  probe sequence for 214705_at
ggaacattgcttttcgtgatactgt

SEQ ID NO: 693 - DNA, 25 bp, Artificial Sequence
  probe sequence for 214705_at
gatactgttaatttcatactatgtt

SEQ ID NO: 694 - DNA, 25 bp, Artificial Sequence
  probe sequence for 214705_at
taattcttcacgatagtagttttct

SEQ ID NO: 695 - DNA, 25 bp, Artificial Sequence
  probe sequence for 209703_x_at
ctgttgcagagaggggtcctggaga

SEQ ID NO: 696 - DNA, 25 bp, Artificial Sequence
  probe sequence for 209703_x_at
gagaaatgggttaccccagttgtct

SEQ ID NO: 697 - DNA, 25 bp, Artificial Sequence
  probe sequence for 209703_x_at
ttaccccagttgtcttatttaaatg

SEQ ID NO: 698 - DNA, 25 bp, Artificial Sequence
  probe sequence for 209703_x_at
aatggttacccatcagattttaatt

SEQ ID NO: 699 - DNA, 25 bp, Artificial Sequence
  probe sequence for 209703_x_at
attttaattttatcttctctttgag

SEQ ID NO: 700 - DNA, 25 bp, Artificial Sequence
  probe sequence for 209703_x_at
gaagcacttaaatcactccaaagaa

SEQ ID NO: 701 - DNA, 25 bp, Artificial Sequence
  probe sequence for 209703_x_at
agcacagattttttctttctgcttt

SEQ ID NO: 702 - DNA, 25 bp, Artificial Sequence
  probe sequence for 209703_x_at
aagagacagggggctgggcgtggtg

SEQ ID NO: 703 - DNA, 25 bp, Artificial Sequence
  probe sequence for 209703_x_at
ggtggatcacgaggtaggagttaaa

SEQ ID NO: 704 - DNA, 25 bp, Artificial Sequence
  probe sequence for 209703_x_at
agtgaaccgagatcatgccattgta

SEQ ID NO: 705 - DNA, 25 bp, Artificial Sequence
  probe sequence for 209703_x_at
ccattgtactctagcctgggtgaca

SEQ ID NO: 706 - DNA, 25 bp, Artificial Sequence
  probe sequence for 215001_s_at
ggctggtcaacttgagcatgttact

SEQ ID NO: 707 - DNA, 25 bp, Artificial Sequence
  probe sequence for 215001_s_at
atagcatgtcactaaagcaggcctt

SEQ ID NO: 708 - DNA, 25 bp, Artificial Sequence
  probe sequence for 215001_s_at
acagaattgcttgtttgcttcaact

SEQ ID NO: 709 - DNA, 25 bp, Artificial Sequence
  probe sequence for 215001_s_at
acagggctggagtcaaaacacttgt

SEQ ID NO: 710 - DNA, 25 bp, Artificial Sequence
  probe sequence for 215001_s_at
attttctggttcttgtgttggctgt

SEQ ID NO: 711 - DNA, 25 bp, Artificial Sequence
  probe sequence for 215001_s_at
gttcttgtgttggctgtggcaggcc

SEQ ID NO: 712 - DNA, 25 bp, Artificial Sequence
  probe sequence for 215001_s_at
tttcttttgccatgacaacttctaa

SEQ ID NO: 713 - DNA, 25 bp, Artificial Sequence
  probe sequence for 215001_s_at
gacaacttctaattgccatgtacag

SEQ ID NO: 714 - DNA, 25 bp, Artificial Sequence
  probe sequence for 215001_s_at
gtcaaataactcctcattgtaaaca

SEQ ID NO: 715 - DNA, 25 bp, Artificial Sequence
  probe sequence for 215001_s_at
acaaactgtgtaactgcccaaagca

SEQ ID NO: 716 - DNA, 25 bp, Artificial Sequence
  probe sequence for 215001_s_at
gcagcacttataaatcagcctaaca

SEQ ID NO: 717 - DNA, 25 bp, Artificial Sequence
  probe sequence for 218155_x_at
aaccacaacattgcctgcatgtcta

SEQ ID NO: 718 - DNA, 25 bp, Artificial Sequence
  probe sequence for 218155_x_at
caacattgcctgcatgtctaaaaga

SEQ ID NO: 719 - DNA, 25 bp, Artificial Sequence
  probe sequence for 218155_x_at
gcctggccaacctggtgaaatgcag

SEQ ID NO: 720 - DNA, 25 bp, Artificial Sequence
  probe sequence for 218155_x_at
acctggtgaaatgcagtgtcaacta

SEQ ID NO: 721 - DNA, 25 bp, Artificial Sequence
  probe sequence for 218155_x_at
aataggaaaatcagccaggcgtggt

SEQ ID NO: 722 - DNA, 25 bp, Artificial Sequence
  probe sequence for 218155_x_at
gaatcacttgaacttgggaggggta

SEQ ID NO: 723 - DNA, 25 bp, Artificial Sequence
  probe sequence for 218155_x_at
aacttgggaggggtaggttgcagtg

SEQ ID NO: 724 - DNA, 25 bp, Artificial Sequence
  probe sequence for 218155_x_at
tgggaggggtaggttgcagtgagct

SEQ ID NO: 725 - DNA, 25 bp, Artificial Sequence
  probe sequence for 218155_x_at
gctgagatcacaccaaaatggggtg

SEQ ID NO: 726 - DNA, 25 bp, Artificial Sequence
  probe sequence for 218155_x_at
caaaatggggtggggcgcagtggct

SEQ ID NO: 727 - DNA, 25 bp, Artificial Sequence
  probe sequence for 218155_x_at
ggcggatcacgaggtagggagatca

SEQ ID NO: 728 - DNA, 25 bp, Artificial Sequence
  probe sequence for 215604_x_at
gaacccaggaagcggaagttgcagt

SEQ ID NO: 729 - DNA, 25 bp, Artificial Sequence
  probe sequence for 215604_x_at
gacagagggagactccgtctccaaa

SEQ ID NO: 730 - DNA, 25 bp, Artificial Sequence
  probe sequence for 215604_x_at
aaagttcaggccgggcacggtagct

SEQ ID NO: 731 - DNA, 25 bp, Artificial Sequence
  probe sequence for 215604_x_at
ggctgatgcaggtggatcaccggag

SEQ ID NO: 732 - DNA, 25 bp, Artificial Sequence
  probe sequence for 215604_x_at
caccggaggtcaggaactagaaatc

SEQ ID NO: 733 - DNA, 25 bp, Artificial Sequence
  probe sequence for 215604_x_at
ggaactagaaatcagcctggccaac

SEQ ID NO: 734 - DNA, 25 bp, Artificial Sequence
  probe sequence for 215604_x_at
ttagacaggtgtggtggtgcgtgcc

SEQ ID NO: 735 - DNA, 25 bp, Artificial Sequence
  probe sequence for 215604_x_at
gaagcagaaaaatcacttgaaccca

SEQ ID NO: 736 - DNA, 25 bp, Artificial Sequence
  probe sequence for 215604_x_at
tgagatcgtgccattgcattccagc

SEQ ID NO: 737 - DNA, 25 bp, Artificial Sequence
  probe sequence for 215604_x_at
cgacaagactgaaactctatccccc

SEQ ID NO: 738 - DNA, 25 bp, Artificial Sequence
  probe sequence for 215604_x_at
taagaaactatattaccagagcaag

SEQ ID NO: 739 - DNA, 25 bp, Artificial Sequence
  probe sequence for 212297_at
gttccccatgtttatgaaagtcctg

SEQ ID NO: 740 - DNA, 25 bp, Artificial Sequence
  probe sequence for 212297_at
aaatattcatgcatgcaattttgac

SEQ ID NO: 741 - DNA, 25 bp, Artificial Sequence
  probe sequence for 212297_at
tgtatatttatggtgggaggtggtt

SEQ ID NO: 742 - DNA, 25 bp, Artificial Sequence
  probe sequence for 212297_at
aatttttgtacagtctgtgggcatt

SEQ ID NO: 743 - DNA, 25 bp, Artificial Sequence
  probe sequence for 212297_at
gtctgtgggcatttacacattttta

SEQ ID NO: 744 - DNA, 25 bp, Artificial Sequence
  probe sequence for 212297_at
aagttacttctagttatgatttgtg

SEQ ID NO: 745 - DNA, 25 bp, Artificial Sequence
  probe sequence for 212297_at
gatttgtgaattccctaagaccttg

SEQ ID NO: 746 - DNA, 25 bp, Artificial Sequence
  probe sequence for 212297_at
aatgatactgcatctttatattttt

SEQ ID NO: 747 - DNA, 25 bp, Artificial Sequence
  probe sequence for 212297_at
aaattgtattgctgctcaagaatgg

SEQ ID NO: 748 - DNA, 25 bp, Artificial Sequence
  probe sequence for 212297_at
agaatggtaccctcttgtcaaaaag

SEQ ID NO: 749 - DNA, 25 bp, Artificial Sequence
  probe sequence for 212297_at
cattcataattgtacattcagcatt

SEQ ID NO: 750 - DNA, 25 bp, Artificial Sequence
  probe sequence for 201804_x_at
ctgaagcgcagaaagctcggccggt

SEQ ID NO: 751 - DNA, 25 bp, Artificial Sequence
  probe sequence for 201804_x_at
gggcaccgtcatgtatgtaggtctc

SEQ ID NO: 752 - DNA, 25 bp, Artificial Sequence
  probe sequence for 201804_x_at
ggtctcacagatttcaagcctggct

SEQ ID NO: 753 - DNA, 25 bp, Artificial Sequence
  probe sequence for 201804_x_at
gcctggctactggattggtgtccgc

SEQ ID NO: 754 - DNA, 25 bp, Artificial Sequence
  probe sequence for 201804_x_at
gtgtccgctatgatgagccactggg

SEQ ID NO: 755 - DNA, 25 bp, Artificial Sequence
  probe sequence for 201804_x_at
aatgccaggccaagtatggcgcctt

SEQ ID NO: 756 - DNA, 25 bp, Artificial Sequence
  probe sequence for 201804_x_at
atggcgcctttgtcaagccagcagt

SEQ ID NO: 757 - DNA, 25 bp, Artificial Sequence
  probe sequence for 201804_x_at
gccagcagtcgtgacggtgggggac

SEQ ID NO: 758 - DNA, 25 bp, Artificial Sequence
  probe sequence for 201804_x_at
tgacacctaaggaattcccctgctt

SEQ ID NO: 759 - DNA, 25 bp, Artificial Sequence
  probe sequence for 201804_x_at
tctcctgaccccattttaattttat

SEQ ID NO: 760 - DNA, 25 bp, Artificial Sequence
  probe sequence for 201804_x_at
tttattcattttttcctttgccatt

SEQ ID NO: 761 - DNA, 25 bp, Artificial Sequence
  probe sequence for 217313_at
tgaaggcctcgggtgcactaaaaga

SEQ ID NO: 762 - DNA, 25 bp, Artificial Sequence
  probe sequence for 217313_at
ggcctcgggtgcactaaaagagtac

SEQ ID NO: 763 - DNA, 25 bp, Artificial Sequence
  probe sequence for 217313_at
gatgacttcaggctggattgtctac

SEQ ID NO: 764 - DNA, 25 bp, Artificial Sequence
  probe sequence for 217313_at
gacttcaggctggattgtctactgt

SEQ ID NO: 765 - DNA, 25 bp, Artificial Sequence
  probe sequence for 217313_at
ggctggattgtctactgtggacagg

SEQ ID NO: 766 - DNA, 25 bp, Artificial Sequence
  probe sequence for 217313_at
tggattgtctactgtggacaggtgt

SEQ ID NO: 767 - DNA, 25 bp, Artificial Sequence
  probe sequence for 217313_at
gacaggtgtttgagaaggtccccct

SEQ ID NO: 768 - DNA, 25 bp, Artificial Sequence
  probe sequence for 217313_at
atacagggaatactgggacctgacc

SEQ ID NO: 769 - DNA, 25 bp, Artificial Sequence
  probe sequence for 217313_at
gcccactgcatccagatcatgaagg

SEQ ID NO: 770 - DNA, 25 bp, Artificial Sequence
  probe sequence for 217313_at
gtggaggagatcgcagccaacaagt

SEQ ID NO: 771 - DNA, 25 bp, Artificial Sequence
  probe sequence for 217313_at
aggagatcgcagccaacaagtgccg

SEQ ID NO: 772 - DNA, 25 bp, Artificial Sequence
  probe sequence for 217949_s_at
gctattgttaggttgcctgcggaca

SEQ ID NO: 773 - DNA, 25 bp, Artificial Sequence
  probe sequence for 217949_s_at
tcttcgtgctctatgatttctgcat

SEQ ID NO: 774 - DNA, 25 bp, Artificial Sequence
  probe sequence for 217949_s_at
tctgcattgtttgtatcaccaccta

SEQ ID NO: 775 - DNA, 25 bp, Artificial Sequence
  probe sequence for 217949_s_at
accacctatgctatcaacgtgagcc

SEQ ID NO: 776 - DNA, 25 bp, Artificial Sequence
  probe sequence for 217949_s_at
gtggctcagtttccggaaggtccaa

SEQ ID NO: 777 - DNA, 25 bp, Artificial Sequence
  probe sequence for 217949_s_at
ggctaagaggcactgagccctcaac

SEQ ID NO: 778 - DNA, 25 bp, Artificial Sequence
  probe sequence for 217949_s_at
gcatgtgagccttgcctaagggggc

SEQ ID NO: 779 - DNA, 25 bp, Artificial Sequence
  probe sequence for 217949_s_at
gcctaagggggcatatctgggtccc

SEQ ID NO: 780 - DNA, 25 bp, Artificial Sequence
  probe sequence for 217949_s_at
tctgggtccctagaaggccctagat

SEQ ID NO: 781 - DNA, 25 bp, Artificial Sequence
  probe sequence for 217949_s_at
gatgtggggcttctagattaccccc

SEQ ID NO: 782 - DNA, 25 bp, Artificial Sequence
  probe sequence for 217949_s_at
ctgccatacccgcacatgacaatgg

SEQ ID NO: 783 - DNA, 25 bp, Artificial Sequence
  probe sequence for 215179_x_at
gaccaacacggtgaaaccacatctc

SEQ ID NO: 784 - DNA, 25 bp, Artificial Sequence
  probe sequence for 215179_x_at
attagctgggcgtgttggtgcatgc

SEQ ID NO: 785 - DNA, 25 bp, Artificial Sequence
  probe sequence for 215179_x_at
aagaattccaaaagcccatgtgctc

SEQ ID NO: 786 - DNA, 25 bp, Artificial Sequence
  probe sequence for 215179_x_at
cccttgcccattcttaagttgacat

SEQ ID NO: 787 - DNA, 25 bp, Artificial Sequence
  probe sequence for 215179_x_at
agtcaagccaggctcagtacctcat

SEQ ID NO: 788 - DNA, 25 bp, Artificial Sequence
  probe sequence for 215179_x_at
agtacctcatgcctgtaattctagc

SEQ ID NO: 789 - DNA, 25 bp, Artificial Sequence
  probe sequence for 215179_x_at
cgagtggatcgcttgaggccaggag

SEQ ID NO: 790 - DNA, 25 bp, Artificial Sequence
  probe sequence for 215179_x_at
ccaggagttcaagcctagccggggc

SEQ ID NO: 791 - DNA, 25 bp, Artificial Sequence
  probe sequence for 215179_x_at
gccggggcaacatggcgaaacctcg

SEQ ID NO: 792 - DNA, 25 bp, Artificial Sequence
  probe sequence for 215179_x_at
actagctggacgtggtgccatgtgc

SEQ ID NO: 793 - DNA, 25 bp, Artificial Sequence
  probe sequence for 215179_x_at
gtggaatgatcacctgagcctggga

SEQ ID NO: 794 - DNA, 25 bp, Artificial Sequence
  probe sequence for 217588_at
cgtcgacgtaagcacttctcagaga

SEQ ID NO: 795 - DNA, 25 bp, Artificial Sequence
  probe sequence for 217588_at
tgggtgccttggggtgtattttact

SEQ ID NO: 796 - DNA, 25 bp, Artificial Sequence
  probe sequence for 217588_at
aacctgtgtgttttccacagtccct

SEQ ID NO: 797 - DNA, 25 bp, Artificial Sequence
  probe sequence for 217588_at
ctgcttcccgaggttgtggtattgg

SEQ ID NO: 798 - DNA, 25 bp, Artificial Sequence
  probe sequence for 217588_at
ggtaggggtaacaggccaatcggtg

SEQ ID NO: 799 - DNA, 25 bp, Artificial Sequence
  probe sequence for 217588_at
caggccaatcggtgtggcttcagct

SEQ ID NO: 800 - DNA, 25 bp, Artificial Sequence
  probe sequence for 217588_at
tctctcaaactccttgcacaattcc

SEQ ID NO: 801 - DNA, 25 bp, Artificial Sequence
  probe sequence for 217588_at
actccttgcacaattccgtcaaatt

SEQ ID NO: 802 - DNA, 25 bp, Artificial Sequence
  probe sequence for 217588_at
ttattttggtcctggtcagggccct

SEQ ID NO: 803 - DNA, 25 bp, Artificial Sequence
  probe sequence for 217588_at
cagggccctcaaggtgatttgactg

SEQ ID NO: 804 - DNA, 25 bp, Artificial Sequence
  probe sequence for 217588_at
gccgagggggatgggtcatgaggtc

SEQ ID NO: 805 - DNA, 25 bp, Artificial Sequence
  probe sequence for 214153_at
ttgttgccagtgcctggtagccata

SEQ ID NO: 806 - DNA, 25 bp, Artificial Sequence
  probe sequence for 214153_at
gtagccataaggcctgctgatctgg

SEQ ID NO: 807 - DNA, 25 bp, Artificial Sequence
  probe sequence for 214153_at
aagtcatatacttctgggcttcata

SEQ ID NO: 808 - DNA, 25 bp, Artificial Sequence
  probe sequence for 214153_at
gggcttcatagtttatggctgcact

SEQ ID NO: 809 - DNA, 25 bp, Artificial Sequence
  probe sequence for 214153_at
atggctgcactgtgggacatacacc

SEQ ID NO: 810 - DNA, 25 bp, Artificial Sequence
  probe sequence for 214153_at
gggacatacaccagctacaaggaag

SEQ ID NO: 811 - DNA, 25 bp, Artificial Sequence
  probe sequence for 214153_at
ggataggacccgatgaagctgaaat

SEQ ID NO: 812 - DNA, 25 bp, Artificial Sequence
  probe sequence for 214153_at
cttatagcagcatagcactttgttc

SEQ ID NO: 813 - DNA, 25 bp, Artificial Sequence
  probe sequence for 214153_at
gaaagaccaatttggccacataacc

SEQ ID NO: 814 - DNA, 25 bp, Artificial Sequence
  probe sequence for 214153_at
cctgtcatctgccatccagatacta

SEQ ID NO: 815 - DNA, 25 bp, Artificial Sequence
  probe sequence for 214153_at
gcctgtgattcagttaacttacctc

SEQ ID NO: 816 - DNA, 25 bp, Artificial Sequence
  probe sequence for 222155_s_at
cctaaggcctatcagcttctatcag

SEQ ID NO: 817 - DNA, 25 bp, Artificial Sequence
  probe sequence for 222155_s_at
aaggcctatcagcttctatcagccc

SEQ ID NO: 818 - DNA, 25 bp, Artificial Sequence
  probe sequence for 222155_s_at
caccaacgcgctgaccaatggcgtg

SEQ ID NO: 819 - DNA, 25 bp, Artificial Sequence
  probe sequence for 222155_s_at
accaacgcgctgaccaatggcgtgc

SEQ ID NO: 820 - DNA, 25 bp, Artificial Sequence
  probe sequence for 222155_s_at
gcgtgttctcctacgtgaaggtggc

SEQ ID NO: 821 - DNA, 25 bp, Artificial Sequence
  probe sequence for 222155_s_at
gtgttctcctacgtgaaggtggcag

SEQ ID NO: 822 - DNA, 25 bp, Artificial Sequence
  probe sequence for 222155_s_at
gttctcctacgtgaaggtggcagcc

SEQ ID NO: 823 - DNA, 25 bp, Artificial Sequence
  probe sequence for 222155_s_at
ctcctacgtgaaggtggcagccagc

SEQ ID NO: 824 - DNA, 25 bp, Artificial Sequence
  probe sequence for 222155_s_at
ctacgtgaaggtggcagccagctcc

SEQ ID NO: 825 - DNA, 25 bp, Artificial Sequence
  probe sequence for 222155_s_at
catctatcacgtgttccacagcaga

SEQ ID NO: 826 - DNA, 25 bp, Artificial Sequence
  probe sequence for 222155_s_at
tctatcacgtgttccacagcagaaa

SEQ ID NO: 827 - DNA, 25 bp, Artificial Sequence
  probe sequence for 211316_x_at
ggctgtgcacagttcaccgagaagc

SEQ ID NO: 828 - DNA, 25 bp, Artificial Sequence
  probe sequence for 211316_x_at
tcttctggagcctgtgtactgcgga

SEQ ID NO: 829 - DNA, 25 bp, Artificial Sequence
  probe sequence for 211316_x_at
tgctggagcagtctcacagctcacc

SEQ ID NO: 830 - DNA, 25 bp, Artificial Sequence
  probe sequence for 211316_x_at
cactcctggatcttcacattgaact

SEQ ID NO: 831 - DNA, 25 bp, Artificial Sequence
  probe sequence for 211316_x_at
tatgtttggctgcagcacactctga

SEQ ID NO: 832 - DNA, 25 bp, Artificial Sequence
  probe sequence for 211316_x_at
gaaagaaacttatcctctcctacac

SEQ ID NO: 833 - DNA, 25 bp, Artificial Sequence
  probe sequence for 211316_x_at
ggccaacatggtaaacgctgtccct

SEQ ID NO: 834 - DNA, 25 bp, Artificial Sequence
  probe sequence for 211316_x_at
gtgggtgtgggtacctgtattccca

SEQ ID NO: 835 - DNA, 25 bp, Artificial Sequence
  probe sequence for 211316_x_at
ggaggatcttttgaacccaggagtt

SEQ ID NO: 836 - DNA, 25 bp, Artificial Sequence
  probe sequence for 211316_x_at
gcatgctgtgattgtgcctacgaat

SEQ ID NO: 837 - DNA, 25 bp, Artificial Sequence
  probe sequence for 211316_x_at
gcctacgaatagccactgcatacca

SEQ ID NO: 838 - DNA, 25 bp, Artificial Sequence
  probe sequence for 217653_x_at
actcattgagagttgggactatttc

SEQ ID NO: 839 - DNA, 25 bp, Artificial Sequence
  probe sequence for 217653_x_at
gagttgggactatttcacacataca

SEQ ID NO: 840 - DNA, 25 bp, Artificial Sequence
  probe sequence for 217653_x_at
cctggcatgtagaagggacttaatg

SEQ ID NO: 841 - DNA, 25 bp, Artificial Sequence
  probe sequence for 217653_x_at
ggggaggcattttaaaatccacatc

SEQ ID NO: 842 - DNA, 25 bp, Artificial Sequence
  probe sequence for 217653_x_at
aaaatgttgttctgtttgggagtgg

SEQ ID NO: 843 - DNA, 25 bp, Artificial Sequence
  probe sequence for 217653_x_at
ggagttcgagatcaacctgagcaac

SEQ ID NO: 844 - DNA, 25 bp, Artificial Sequence
  probe sequence for 217653_x_at
agatcaacctgagcaacatggtgaa

SEQ ID NO: 845 - DNA, 25 bp, Artificial Sequence
  probe sequence for 217653_x_at
tacaaacattagctgagcatggggg

SEQ ID NO: 846 - DNA, 25 bp, Artificial Sequence
  probe sequence for 217653_x_at
gctacttgggaggcttaggcacttg

SEQ ID NO: 847 - DNA, 25 bp, Artificial Sequence
  probe sequence for 217653_x_at
aggcttaggcacttgaatgagaatc

SEQ ID NO: 848 - DNA, 25 bp, Artificial Sequence
  probe sequence for 217653_x_at
tgaatgagaatcacttggacccagg

SEQ ID NO: 849 - DNA, 25 bp, Artificial Sequence
  probe sequence for 266_s_at
ttcacaaacttttatactctttctg

SEQ ID NO: 850 - DNA, 25 bp, Artificial Sequence
  probe sequence for 266_s_at
gtcctaagcctaaaagtgggcttga

SEQ ID NO: 851 - DNA, 25 bp, Artificial Sequence
  probe sequence for 266_s_at
agtgggcttgattctgcagtaaatc

SEQ ID NO: 852 - DNA, 25 bp, Artificial Sequence
  probe sequence for 266_s_at
cagtaaatcttttacaactgcctcg

SEQ ID NO: 853 - DNA, 25 bp, Artificial Sequence
  probe sequence for 266_s_at
gcctcgacacacataaaccttttta

SEQ ID NO: 854 - DNA, 25 bp, Artificial Sequence
  probe sequence for 266_s_at
acactgatgcttagatgttccagta

SEQ ID NO: 855 - DNA, 25 bp, Artificial Sequence
  probe sequence for 266_s_at
gtaatctaatatggccacagtagtc

SEQ ID NO: 856 - DNA, 25 bp, Artificial Sequence
  probe sequence for 266_s_at
cacagtagtcttgatgaccaaagtc

SEQ ID NO: 857 - DNA, 25 bp, Artificial Sequence
  probe sequence for 266_s_at
tttccatctttagaaaactacatgg

SEQ ID NO: 858 - DNA, 25 bp, Artificial Sequence
  probe sequence for 266_s_at
ggaacaaacagatcgaacagttttg

SEQ ID NO: 859 - DNA, 25 bp, Artificial Sequence
  probe sequence for 266_s_at
ctactgtgtgtgtgaatgaacactc

SEQ ID NO: 860 - DNA, 25 bp, Artificial Sequence
  probe sequence for 266_s_at
aacactcttgctttattccagaatg

SEQ ID NO: 861 - DNA, 25 bp, Artificial Sequence
  probe sequence for 266_s_at
tattccagaatgctgtacatctatt

SEQ ID NO: 862 - DNA, 25 bp, Artificial Sequence
  probe sequence for 266_s_at
tgctgtacatctattttggattgta

SEQ ID NO: 863 - DNA, 25 bp, Artificial Sequence
  probe sequence for 266_s_at
tttacgctttgattcatagtaactt

SEQ ID NO: 864 - DNA, 25 bp, Artificial Sequence
  probe sequence for 266_s_at
catagtaacttcttatggaattgat

SEQ ID NO: 865 - DNA, 25 bp, Artificial Sequence
  probe sequence for 204718_at
cacttggcagaaggaccgtgcccgg

SEQ ID NO: 866 - DNA, 25 bp, Artificial Sequence
  probe sequence for 204718_at
aagatgatccgcaagccagataccc

SEQ ID NO: 867 - DNA, 25 bp, Artificial Sequence
  probe sequence for 204718_at
aagccagataccctgcaggctggcg

SEQ ID NO: 868 - DNA, 25 bp, Artificial Sequence
  probe sequence for 204718_at
ggctttcagccattggactggagtg

SEQ ID NO: 869 - DNA, 25 bp, Artificial Sequence
  probe sequence for 204718_at
ggacaacttctccaagtttggcctc

SEQ ID NO: 870 - DNA, 25 bp, Artificial Sequence
  probe sequence for 204718_at
cttcagtgatgtggctcagctcagc

SEQ ID NO: 871 - DNA, 25 bp, Artificial Sequence
  probe sequence for 204718_at
ctcagctcagcctagaagacctgcc

SEQ ID NO: 872 - DNA, 25 bp, Artificial Sequence
  probe sequence for 204718_at
tccttcagcaacacctgaggcagca

SEQ ID NO: 873 - DNA, 25 bp, Artificial Sequence
  probe sequence for 204718_at
gaatgacgatacccgtgactcagcc

SEQ ID NO: 874 - DNA, 25 bp, Artificial Sequence
  probe sequence for 204718_at
aagggacatgtgggacgtgagccgg

SEQ ID NO: 875 - DNA, 25 bp, Artificial Sequence
  probe sequence for 204718_at
aacagcctctgtgagagatgcccca

SEQ ID NO: 876 - DNA, 25 bp, Artificial Sequence
  probe sequence for 203704_s_at
gatgctgagattcaatcactacatg

SEQ ID NO: 877 - DNA, 25 bp, Artificial Sequence
  probe sequence for 203704_s_at
tcactacatgaaacacctggctgtg

SEQ ID NO: 878 - DNA, 25 bp, Artificial Sequence
  probe sequence for 203704_s_at
acaacccagagggctgtgttccaag

SEQ ID NO: 879 - DNA, 25 bp, Artificial Sequence
  probe sequence for 203704_s_at
caagcagcgctggggaagctacgta

SEQ ID NO: 880 - DNA, 25 bp, Artificial Sequence
  probe sequence for 203704_s_at
gaagctacgtaacagtcggatgcca

SEQ ID NO: 881 - DNA, 25 bp, Artificial Sequence
  probe sequence for 203704_s_at
gtaacagtcggatgccagttttgga

SEQ ID NO: 882 - DNA, 25 bp, Artificial Sequence
  probe sequence for 203704_s_at
tggaagattcaccatgcgttctgac

SEQ ID NO: 883 - DNA, 25 bp, Artificial Sequence
  probe sequence for 203704_s_at
tgatcctagtgatttcagcccatgc

SEQ ID NO: 884 - DNA, 25 bp, Artificial Sequence
  probe sequence for 203704_s_at
aaaaactgctgctacatgttatgta

SEQ ID NO: 885 - DNA, 25 bp, Artificial Sequence
  probe sequence for 203704_s_at
aaactggtttatgccacatgaacag

SEQ ID NO: 886 - DNA, 25 bp, Artificial Sequence
  probe sequence for 203704_s_at
gttcctctttgtattcagttgtata

SEQ ID NO: 887 - DNA, 25 bp, Artificial Sequence
  probe sequence for 220934_s_at
tgaagcaggtatcttgcatggccca

SEQ ID NO: 888 - DNA, 25 bp, Artificial Sequence
  probe sequence for 220934_s_at
tgccatgctacctctgaaagtcaaa

SEQ ID NO: 889 - DNA, 25 bp, Artificial Sequence
  probe sequence for 220934_s_at
aagtcaaaggccgacgcttctattt

SEQ ID NO: 890 - DNA, 25 bp, Artificial Sequence
  probe sequence for 220934_s_at
acgcttctatttcctcttggacaaa

SEQ ID NO: 891 - DNA, 25 bp, Artificial Sequence
  probe sequence for 220934_s_at
caaaactggacacttccctaacaca

SEQ ID NO: 892 - DNA, 25 bp, Artificial Sequence
  probe sequence for 220934_s_at
tgacaatactgtgggtgcctaccgg

SEQ ID NO: 893 - DNA, 25 bp, Artificial Sequence
  probe sequence for 220934_s_at
gtgcctaccggagcttgtgaagaaa

SEQ ID NO: 894 - DNA, 25 bp, Artificial Sequence
  probe sequence for 220934_s_at
aaatgacctcaagtcactcacctct

SEQ ID NO: 895 - DNA, 25 bp, Artificial Sequence
  probe sequence for 220934_s_at
gtcactcacctctccaagaggagga

SEQ ID NO: 896 - DNA, 25 bp, Artificial Sequence
  probe sequence for 220934_s_at
gtgttggttcacacctgttgtaatc

SEQ ID NO: 897 - DNA, 25 bp, Artificial Sequence
  probe sequence for 220934_s_at
taaaggagcagtcatccctagggca

SEQ ID NO: 898 - DNA, 25 bp, Artificial Sequence
  probe sequence for 211916_s_at
aaagctctgtgccagtgaactgttc

SEQ ID NO: 899 - DNA, 25 bp, Artificial Sequence
  probe sequence for 211916_s_at
agggcaagaaggcttcatatcccca

SEQ ID NO: 900 - DNA, 25 bp, Artificial Sequence
  probe sequence for 211916_s_at
tccccattccattctgtggtgacta

SEQ ID NO: 901 - DNA, 25 bp, Artificial Sequence
  probe sequence for 211916_s_at
gtggtgactacattgggctgcaagg

SEQ ID NO: 902 - DNA, 25 bp, Artificial Sequence
  probe sequence for 211916_s_at
gcaagggaaccccaagctgcagaag

SEQ ID NO: 903 - DNA, 25 bp, Artificial Sequence
  probe sequence for 211916_s_at
atggcaagacttcttctcggattct

SEQ ID NO: 904 - DNA, 25 bp, Artificial Sequence
  probe sequence for 211916_s_at
tcctcctgaccaagggccatgtgat

SEQ ID NO: 905 - DNA, 25 bp, Artificial Sequence
  probe sequence for 211916_s_at
gaagtcccaggccaaaattgtcatt

SEQ ID NO: 906 - DNA, 25 bp, Artificial Sequence
  probe sequence for 211916_s_at
gatgggctctttagcttgcatctga

SEQ ID NO: 907 - DNA, 25 bp, Artificial Sequence
  probe sequence for 211916_s_at
gaccaaaatgtaccgggctgtgctg

SEQ ID NO: 908 - DNA, 25 bp, Artificial Sequence
  probe sequence for 211916_s_at
cacgcagaggcagcttacagtcacc

SEQ ID NO: 909 - DNA, 25 bp, Artificial Sequence
  probe sequence for 206929_s_at
ccacgagtagcagccgcaactggac

SEQ ID NO: 910 - DNA, 25 bp, Artificial Sequence
  probe sequence for 206929_s_at
gtagcagccgcaactggacggagga

SEQ ID NO: 911 - DNA, 25 bp, Artificial Sequence
  probe sequence for 206929_s_at
gcaactggacggaggacatggaagg

SEQ ID NO: 912 - DNA, 25 bp, Artificial Sequence
  probe sequence for 206929_s_at
acatggaaggaggcatctcgtcccc

SEQ ID NO: 913 - DNA, 25 bp, Artificial Sequence
  probe sequence for 206929_s_at
gcatctcgtccccggtgaagaagac

SEQ ID NO: 914 - DNA, 25 bp, Artificial Sequence
  probe sequence for 206929_s_at
tctcgtccccggtgaagaagacaga

SEQ ID NO: 915 - DNA, 25 bp, Artificial Sequence
  probe sequence for 206929_s_at
tggacaagtcaccattcaacagccc

SEQ ID NO: 916 - DNA, 25 bp, Artificial Sequence
  probe sequence for 206929_s_at
gtcctggtatctgggatagcaaagg

SEQ ID NO: 917 - DNA, 25 bp, Artificial Sequence
  probe sequence for 206929_s_at
ctgggatagcaaaggtcttcttccc

SEQ ID NO: 918 - DNA, 25 bp, Artificial Sequence
  probe sequence for 206929_s_at
tagagtgaacaagaacacccctgcc

SEQ ID NO: 919 - DNA, 25 bp, Artificial Sequence
  probe sequence for 206929_s_at
aaacacatagacgcacacactcagg

SEQ ID NO: 920 - DNA, 25 bp, Artificial Sequence
  probe sequence for 215032_at
ttcttatctcttggcatgtttggga

SEQ ID NO: 921 - DNA, 25 bp, Artificial Sequence
  probe sequence for 215032_at
tgtccaaggtcacgcaatctgaact

SEQ ID NO: 922 - DNA, 25 bp, Artificial Sequence
  probe sequence for 215032_at
cccagggacacagagtttgtgatca

SEQ ID NO: 923 - DNA, 25 bp, Artificial Sequence
  probe sequence for 215032_at
actgaataattctgccacgtcttta

SEQ ID NO: 924 - DNA, 25 bp, Artificial Sequence
  probe sequence for 215032_at
ttctgccacgtctttattgtcatgc

SEQ ID NO: 925 - DNA, 25 bp, Artificial Sequence
  probe sequence for 215032_at
tttattgtcatgccttcatcaccta

SEQ ID NO: 926 - DNA, 25 bp, Artificial Sequence
  probe sequence for 215032_at
tgccttcatcacctactacgtatga

SEQ ID NO: 927 - DNA, 25 bp, Artificial Sequence
  probe sequence for 215032_at
gagggatttaagggtgagggagaga

SEQ ID NO: 928 - DNA, 25 bp, Artificial Sequence
  probe sequence for 215032_at
gacagacacaggcataagagacaaa

SEQ ID NO: 929 - DNA, 25 bp, Artificial Sequence
  probe sequence for 215032_at
aattcaagccaggtgtaggggtgca

SEQ ID NO: 930 - DNA, 25 bp, Artificial Sequence
  probe sequence for 215032_at
cacacctgtagccctagttactagg

SEQ ID NO: 931 - DNA, 25 bp, Artificial Sequence
  probe sequence for 219920_s_at
ggccagaactgcagcattggcccca

SEQ ID NO: 932 - DNA, 25 bp, Artificial Sequence
  probe sequence for 219920_s_at
ttggccccaatgtgagcctgggacc

SEQ ID NO: 933 - DNA, 25 bp, Artificial Sequence
  probe sequence for 219920_s_at
cctggcgtggtggtcgaagatggtg

SEQ ID NO: 934 - DNA, 25 bp, Artificial Sequence
  probe sequence for 219920_s_at
gatgagctctacctcaacggagcca

SEQ ID NO: 935 - DNA, 25 bp, Artificial Sequence
  probe sequence for 219920_s_at
tgctgccccacaagtctattggcga

SEQ ID NO: 936 - DNA, 25 bp, Artificial Sequence
  probe sequence for 219920_s_at
ccagagcctcgtatcatcatgtgag

SEQ ID NO: 937 - DNA, 25 bp, Artificial Sequence
  probe sequence for 219920_s_at
agtgctggcctgacacatcagaaga

SEQ ID NO: 938 - DNA, 25 bp, Artificial Sequence
  probe sequence for 219920_s_at
catcagaagaccctggacttgtcat

SEQ ID NO: 939 - DNA, 25 bp, Artificial Sequence
  probe sequence for 219920_s_at
gtcattatttgtctggggggcactg

SEQ ID NO: 940 - DNA, 25 bp, Artificial Sequence
  probe sequence for 219920_s_at
gtggacatcatctggcaggatccct

SEQ ID NO: 941 - DNA, 25 bp, Artificial Sequence
  probe sequence for 219920_s_at
cccactccctcaagaagggccaggg

SEQ ID NO: 942 - DNA, 25 bp, Artificial Sequence
  probe sequence for 211996_s_at
aaaccacgcaaacccaagaggcaga

SEQ ID NO: 943 - DNA, 25 bp, Artificial Sequence
  probe sequence for 211996_s_at
agagggcggctgagatggaaccacc

SEQ ID NO: 944 - DNA, 25 bp, Artificial Sequence
  probe sequence for 211996_s_at
caagaggcggagggtcggtgacgtg

SEQ ID NO: 945 - DNA, 25 bp, Artificial Sequence
  probe sequence for 211996_s_at
aaccgtcacgcaaacccaagaggcg

SEQ ID NO: 946 - DNA, 25 bp, Artificial Sequence
  probe sequence for 211996_s_at
caagaggcggagggccgctgacgtg

SEQ ID NO: 947 - DNA, 25 bp, Artificial Sequence
  probe sequence for 211996_s_at
agaggcggagggtcggtgatgtgga

SEQ ID NO: 948 - DNA, 25 bp, Artificial Sequence
  probe sequence for 211996_s_at
tgatgtggaaccgtcacgcaaaccc

SEQ ID NO: 949 - DNA, 25 bp, Artificial Sequence
  probe sequence for 211996_s_at
ccaagaggcggagggtcggtgacgt

SEQ ID NO: 950 - DNA, 25 bp, Artificial Sequence
  probe sequence for 211996_s_at
ggtcggtgacgtggaaccgtcacgc

SEQ ID NO: 951 - DNA, 25 bp, Artificial Sequence
  probe sequence for 211996_s_at
gccgctgacgtggaaccatcattac

SEQ ID NO: 952 - DNA, 25 bp, Artificial Sequence
  probe sequence for 211996_s_at
tgagaagaggccagtgcactcaagc

SEQ ID NO: 953 - DNA, 25 bp, Artificial Sequence
  probe sequence for 200075_s_at
ccgcatctgtgtgctggacgtggac

SEQ ID NO: 954 - DNA, 25 bp, Artificial Sequence
  probe sequence for 200075_s_at
ggacctgcagggtgtgcggaacatc

SEQ ID NO: 955 - DNA, 25 bp, Artificial Sequence
  probe sequence for 200075_s_at
gtgcggaacatcaaggccaccgatc

SEQ ID NO: 956 - DNA, 25 bp, Artificial Sequence
  probe sequence for 200075_s_at
gcggcagcgcaacactgaaaccgag

SEQ ID NO: 957 - DNA, 25 bp, Artificial Sequence
  probe sequence for 200075_s_at
tgcccaggccgacatggagagcagc

SEQ ID NO: 958 - DNA, 25 bp, Artificial Sequence
  probe sequence for 200075_s_at
gatgtggtcatcattaacgacagcc

SEQ ID NO: 959 - DNA, 25 bp, Artificial Sequence
  probe sequence for 200075_s_at
tcatcattaacgacagcctggacca

SEQ ID NO: 960 - DNA, 25 bp, Artificial Sequence
  probe sequence for 200075_s_at
gaaggaggcgctctctgaggaaatc

SEQ ID NO: 961 - DNA, 25 bp, Artificial Sequence
  probe sequence for 200075_s_at
aatcaagaaagctcaaaggaccggc

SEQ ID NO: 962 - DNA, 25 bp, Artificial Sequence
  probe sequence for 200075_s_at
cccttggccagcatgtggagtggag

SEQ ID NO: 963 - DNA, 25 bp, Artificial Sequence
  probe sequence for 200075_s_at
tcactctggacccagggctgacatc

SEQ ID NO: 964 - DNA, 25 bp, Artificial Sequence
  probe sequence for 214753_at
tcccttgccttcactgtaatgctta

SEQ ID NO: 965 - DNA, 25 bp, Artificial Sequence
  probe sequence for 214753_at
taatgcttaatggttgtgtagtctt

SEQ ID NO: 966 - DNA, 25 bp, Artificial Sequence
  probe sequence for 214753_at
gtcttatacgtgactcctgacttca

SEQ ID NO: 967 - DNA, 25 bp, Artificial Sequence
  probe sequence for 214753_at
cctgacttcaaggatcctggtctgt

SEQ ID NO: 968 - DNA, 25 bp, Artificial Sequence
  probe sequence for 214753_at
atcctggtctgtacctctttaggtc

SEQ ID NO: 969 - DNA, 25 bp, Artificial Sequence
  probe sequence for 214753_at
tacctctttaggtcaacacgttttg

SEQ ID NO: 970 - DNA, 25 bp, Artificial Sequence
  probe sequence for 214753_at
acgttttgagtgaactggtgttggt

SEQ ID NO: 971 - DNA, 25 bp, Artificial Sequence
  probe sequence for 214753_at
ggaatggcttcatataggagttcac

SEQ ID NO: 972 - DNA, 25 bp, Artificial Sequence
  probe sequence for 214753_at
gagttgagctgattggaggaccaaa

SEQ ID NO: 973 - DNA, 25 bp, Artificial Sequence
  probe sequence for 214753_at
gaccaaattaaaagactggctgggc

SEQ ID NO: 974 - DNA, 25 bp, Artificial Sequence
  probe sequence for 214753_at
agcctagataacctgggtatcccag

SEQ ID NO: 975 - DNA, 25 bp, Artificial Sequence
  probe sequence for 220459_at
gaaatgtgactttgtaatcccagga

SEQ ID NO: 976 - DNA, 25 bp, Artificial Sequence
  probe sequence for 220459_at
gcaccaagaagttactgttacctca

SEQ ID NO: 977 - DNA, 25 bp, Artificial Sequence
  probe sequence for 220459_at
tggatggctcttatcatcatcttta

SEQ ID NO: 978 - DNA, 25 bp, Artificial Sequence
  probe sequence for 220459_at
gtgcccactactcaatttgactggc

SEQ ID NO: 979 - DNA, 25 bp, Artificial Sequence
  probe sequence for 220459_at
agacataatacttgcttctgagcct

SEQ ID NO: 980 - DNA, 25 bp, Artificial Sequence
  probe sequence for 220459_at
agcagtatttgcatggttccagtga

SEQ ID NO: 981 - DNA, 25 bp, Artificial Sequence
  probe sequence for 220459_at
tcacctttatacacacgttaacaga

SEQ ID NO: 982 - DNA, 25 bp, Artificial Sequence
  probe sequence for 220459_at
acagaaatcatctgatcccctttgc

SEQ ID NO: 983 - DNA, 25 bp, Artificial Sequence
  probe sequence for 220459_at
gatcccctttgctgctaagtgagtt

SEQ ID NO: 984 - DNA, 25 bp, Artificial Sequence
  probe sequence for 220459_at
gaaaagcgaaagcgtctgaatccca

SEQ ID NO: 985 - DNA, 25 bp, Artificial Sequence
  probe sequence for 220459_at
gaatcccaccagcatcgctggatgt

SEQ ID NO: 986 - DNA, 25 bp, Artificial Sequence
  probe sequence for 215645_at
ggaggaagggctgaaatgctttcta

SEQ ID NO: 987 - DNA, 25 bp, Artificial Sequence
  probe sequence for 215645_at
gatactatctgggcatattacttcc

SEQ ID NO: 988 - DNA, 25 bp, Artificial Sequence
  probe sequence for 215645_at
atctgggcatattacttcctgtggt

SEQ ID NO: 989 - DNA, 25 bp, Artificial Sequence
  probe sequence for 215645_at
gggcatattacttcctgtggttcac

SEQ ID NO: 990 - DNA, 25 bp, Artificial Sequence
  probe sequence for 215645_at
tattacttcctgtggttcactgtct

SEQ ID NO: 991 - DNA, 25 bp, Artificial Sequence
  probe sequence for 215645_at
tgtctgggtgacaggattcatagaa

SEQ ID NO: 992 - DNA, 25 bp, Artificial Sequence
  probe sequence for 215645_at
caggattcatagaagcccaaacttt

SEQ ID NO: 993 - DNA, 25 bp, Artificial Sequence
  probe sequence for 215645_at
acccttgtaacaaagccgcacacgt

SEQ ID NO: 994 - DNA, 25 bp, Artificial Sequence
  probe sequence for 215645_at
ttgtaacaaagccgcacacgtacgc

SEQ ID NO: 995 - DNA, 25 bp, Artificial Sequence
  probe sequence for 215645_at
cacgtacgccctcaagctaaaacaa

SEQ ID NO: 996 - DNA, 25 bp, Artificial Sequence
  probe sequence for 215645_at
gcctggcagataacggtgaaacccc

SEQ ID NO: 997 - DNA, 25 bp, Artificial Sequence
  probe sequence for 204102_s_at
gccatcactcaaccataacacttga

SEQ ID NO: 998 - DNA, 25 bp, Artificial Sequence
  probe sequence for 204102_s_at
caaccataacacttgatgccgtttc

SEQ ID NO: 999 - DNA, 25 bp, Artificial Sequence
  probe sequence for 204102_s_at
ataacacttgatgccgtttctttca

SEQ ID NO: 1000 - DNA, 25 bp, Artificial Sequence
  probe sequence for 204102_s_at
acacttgatgccgtttctttcaata

SEQ ID NO: 1001 - DNA, 25 bp, Artificial Sequence
  probe sequence for 204102_s_at
gatgccgtttctttcaatatttatt

SEQ ID NO: 1002 - DNA, 25 bp, Artificial Sequence
  probe sequence for 204102_s_at
tcaatatttatttccagagtccgga

SEQ ID NO: 1003 - DNA, 25 bp, Artificial Sequence
  probe sequence for 204102_s_at
tttatttccagagtccggaggcagc

SEQ ID NO: 1004 - DNA, 25 bp, Artificial Sequence
  probe sequence for 204102_s_at
gcagacacgccctcttagtagggac

SEQ ID NO: 1005 - DNA, 25 bp, Artificial Sequence
  probe sequence for 204102_s_at
gacacgccctcttagtagggactta

SEQ ID NO: 1006 - DNA, 25 bp, Artificial Sequence
  probe sequence for 204102_s_at
cacgccctcttagtagggacttaat

SEQ ID NO: 1007 - DNA, 25 bp, Artificial Sequence
  probe sequence for 204102_s_at
tagtagggacttaatgggccggtcg

SEQ ID NO: 1008 - DNA, 25 bp, Artificial Sequence
  probe sequence for 202419_at
agccctgtgttgtgctcaggactca

SEQ ID NO: 1009 - DNA, 25 bp, Artificial Sequence
  probe sequence for 202419_at
tgctgctggtggaaactcatggctt

SEQ ID NO: 1010 - DNA, 25 bp, Artificial Sequence
  probe sequence for 202419_at
tctctctttgatcccataaagctac

SEQ ID NO: 1011 - DNA, 25 bp, Artificial Sequence
  probe sequence for 202419_at
aatgctttcttgtctttagactcaa

SEQ ID NO: 1012 - DNA, 25 bp, Artificial Sequence
  probe sequence for 202419_at
gcttagggaacgtttcatttctcat

SEQ ID NO: 1013 - DNA, 25 bp, Artificial Sequence
  probe sequence for 202419_at
aaggcagcctccttaaatgttttct

SEQ ID NO: 1014 - DNA, 25 bp, Artificial Sequence
  probe sequence for 202419_at
tttacagttccttcaataaccatga

SEQ ID NO: 1015 - DNA, 25 bp, Artificial Sequence
  probe sequence for 202419_at
tgaagttcacctatcccattttagc

SEQ ID NO: 1016 - DNA, 25 bp, Artificial Sequence
  probe sequence for 202419_at
ctcttcctttccaattttgcttata

SEQ ID NO: 1017 - DNA, 25 bp, Artificial Sequence
  probe sequence for 202419_at
gaccagctaaaattttcgacttgac

SEQ ID NO: 1018 - DNA, 25 bp, Artificial Sequence
  probe sequence for 202419_at
aagtgtgactttttctcggagcata

SEQ ID NO: 1019 - DNA, 25 bp, Artificial Sequence
  probe sequence for 214715_x_at
gccaaggcaagcagatcacctgaag

SEQ ID NO: 1020 - DNA, 25 bp, Artificial Sequence
  probe sequence for 214715_x_at
acctgaagtcaggagagaccagcct

SEQ ID NO: 1021 - DNA, 25 bp, Artificial Sequence
  probe sequence for 214715_x_at
tggccagcatagtgaaaccccatct

SEQ ID NO: 1022 - DNA, 25 bp, Artificial Sequence
  probe sequence for 214715_x_at
aaaatacaaacttagctgggcttag

SEQ ID NO: 1023 - DNA, 25 bp, Artificial Sequence
  probe sequence for 214715_x_at
gctgggcttagtggtgcatgcctgt

SEQ ID NO: 1024 - DNA, 25 bp, Artificial Sequence
  probe sequence for 214715_x_at
gcttgaatccaagaggcagaggttc

SEQ ID NO: 1025 - DNA, 25 bp, Artificial Sequence
  probe sequence for 214715_x_at
ggagatcattccattacactccagc

SEQ ID NO: 1026 - DNA, 25 bp, Artificial Sequence
  probe sequence for 214715_x_at
ctgggcaccaggaacgaaactcgtt

SEQ ID NO: 1027 - DNA, 25 bp, Artificial Sequence
  probe sequence for 214715_x_at
aaaacgttggctgggcatggtggct

SEQ ID NO: 1028 - DNA, 25 bp, Artificial Sequence
  probe sequence for 214715_x_at
gaggcaggtggattacttaaggtca

SEQ ID NO: 1029 - DNA, 25 bp, Artificial Sequence
  probe sequence for 214715_x_at
gaacccaggtggtggaggctgcagt

SEQ ID NO: 1030 - DNA, 25 bp, Artificial Sequence
  probe sequence for 216859_x_at
ccaacagctcactgagaacgggtca

SEQ ID NO: 1031 - DNA, 25 bp, Artificial Sequence
  probe sequence for 216859_x_at
acagctcactgagaacgggtcatga

SEQ ID NO: 1032 - DNA, 25 bp, Artificial Sequence
  probe sequence for 216859_x_at
agctcactgagaacgggtcatgatg

SEQ ID NO: 1033 - DNA, 25 bp, Artificial Sequence
  probe sequence for 216859_x_at
cactgagaacgggtcatgatgacga

SEQ ID NO: 1034 - DNA, 25 bp, Artificial Sequence
  probe sequence for 216859_x_at
gagaaatcagattgttgctgtgtct

SEQ ID NO: 1035 - DNA, 25 bp, Artificial Sequence
  probe sequence for 216859_x_at
gattgttgctgtgtctgtgtagaaa

SEQ ID NO: 1036 - DNA, 25 bp, Artificial Sequence
  probe sequence for 216859_x_at
gaagtagacacaggagactccactt

SEQ ID NO: 1037 - DNA, 25 bp, Artificial Sequence
  probe sequence for 216859_x_at
gacacaggagactccactttgttct

SEQ ID NO: 1038 - DNA, 25 bp, Artificial Sequence
  probe sequence for 216859_x_at
acaggagactccactttgttctgta

SEQ ID NO: 1039 - DNA, 25 bp, Artificial Sequence
  probe sequence for 216859_x_at
agacctctgttcacttgtttatttg

SEQ ID NO: 1040 - DNA, 25 bp, Artificial Sequence
  probe sequence for 216859_x_at
tctgttcacttgtttatttgctgac

SEQ ID NO: 1041 - DNA, 25 bp, Artificial Sequence
  probe sequence for 215529_x_at
tttgatatctcatttccatgtaaca

SEQ ID NO: 1042 - DNA, 25 bp, Artificial Sequence
  probe sequence for 215529_x_at
aaagatgttctattctagttggaga

SEQ ID NO: 1043 - DNA, 25 bp, Artificial Sequence
  probe sequence for 215529_x_at
gtgactaataactgtaagactctct

SEQ ID NO: 1044 - DNA, 25 bp, Artificial Sequence
  probe sequence for 215529_x_at
tgtgttgactcaaattcatttctga

SEQ ID NO: 1045 - DNA, 25 bp, Artificial Sequence
  probe sequence for 215529_x_at
aagcaccaagtttcaggccaggagt

SEQ ID NO: 1046 - DNA, 25 bp, Artificial Sequence
  probe sequence for 215529_x_at
tgaggcaggcggattacctgaggtc

SEQ ID NO: 1047 - DNA, 25 bp, Artificial Sequence
  probe sequence for 215529_x_at
ggacaatatgatgagaccccgtctc

SEQ ID NO: 1048 - DNA, 25 bp, Artificial Sequence
  probe sequence for 215529_x_at
aaattagctggctggtggtgcgcgc

SEQ ID NO: 1049 - DNA, 25 bp, Artificial Sequence
  probe sequence for 215529_x_at
ttgtcccggctacttgggaggttga

SEQ ID NO: 1050 - DNA, 25 bp, Artificial Sequence
  probe sequence for 215529_x_at
gaggttgaggcacaagaatcgcttg

SEQ ID NO: 1051 - DNA, 25 bp, Artificial Sequence
  probe sequence for 215529_x_at
ggaggttgcagcgagccaagatctc

SEQ ID NO: 1052 - DNA, 25 bp, Artificial Sequence
  probe sequence for 202936_s_at
gtagtgtatcactgagtcatttgca

SEQ ID NO: 1053 - DNA, 25 bp, Artificial Sequence
  probe sequence for 202936_s_at
tgttttctgccacagacctttgggc

SEQ ID NO: 1054 - DNA, 25 bp, Artificial Sequence
  probe sequence for 202936_s_at
tgggctgccttatattgtgtgtgtg

SEQ ID NO: 1055 - DNA, 25 bp, Artificial Sequence
  probe sequence for 202936_s_at
aagcatgtgtcatccatatttctct

SEQ ID NO: 1056 - DNA, 25 bp, Artificial Sequence
  probe sequence for 202936_s_at
ttggagtgagggaggctacctggag

SEQ ID NO: 1057 - DNA, 25 bp, Artificial Sequence
  probe sequence for 202936_s_at
ctacctggaggggatcagcccactg

SEQ ID NO: 1058 - DNA, 25 bp, Artificial Sequence
  probe sequence for 202936_s_at
cagcccactgacagaccttaatctt

SEQ ID NO: 1059 - DNA, 25 bp, Artificial Sequence
  probe sequence for 202936_s_at
attactgctgtggctagagagtttg

SEQ ID NO: 1060 - DNA, 25 bp, Artificial Sequence
  probe sequence for 202936_s_at
atatggcatccttcaatttctgtat

SEQ ID NO: 1061 - DNA, 25 bp, Artificial Sequence
  probe sequence for 202936_s_at
gtaaaagctttggtttgtgttcgtg

SEQ ID NO: 1062 - DNA, 25 bp, Artificial Sequence
  probe sequence for 202936_s_at
tgttctctccgtgaaacttaccttt

SEQ ID NO: 1063 - DNA, 25 bp, Artificial Sequence
  probe sequence for 212130_x_at
ttcactttctagacgattacaaaca

SEQ ID NO: 1064 - DNA, 25 bp, Artificial Sequence
  probe sequence for 212130_x_at
cagagttccctaccctaagagaatg

SEQ ID NO: 1065 - DNA, 25 bp, Artificial Sequence
  probe sequence for 212130_x_at
gttaccacctgaacagtcctcggtg

SEQ ID NO: 1066 - DNA, 25 bp, Artificial Sequence
  probe sequence for 212130_x_at
ggcagaagcaccagctgtactacta

SEQ ID NO: 1067 - DNA, 25 bp, Artificial Sequence
  probe sequence for 212130_x_at
ggtgtctccaacctgactaggtgga

SEQ ID NO: 1068 - DNA, 25 bp, Artificial Sequence
  probe sequence for 212130_x_at
gccctcttaccgctagcgaggtgat

SEQ ID NO: 1069 - DNA, 25 bp, Artificial Sequence
  probe sequence for 212130_x_at
gtgataggacatctggcttgccaca

SEQ ID NO: 1070 - DNA, 25 bp, Artificial Sequence
  probe sequence for 212130_x_at
gcttgccacaaaggtctgttcgacc

SEQ ID NO: 1071 - DNA, 25 bp, Artificial Sequence
  probe sequence for 212130_x_at
gttcgaccagacatatcctagctaa

SEQ ID NO: 1072 - DNA, 25 bp, Artificial Sequence
  probe sequence for 212130_x_at
gaatgtgaggccaaccttctatcag

SEQ ID NO: 1073 - DNA, 25 bp, Artificial Sequence
  probe sequence for 212130_x_at
cagctgcccaatgccatgtgaagta

SEQ ID NO: 1074 - DNA, 25 bp, Artificial Sequence
  probe sequence for 217336_at
agaaccagattgccatttatgactc

SEQ ID NO: 1075 - DNA, 25 bp, Artificial Sequence
  probe sequence for 217336_at
accagattgccatttatgactcctt

SEQ ID NO: 1076 - DNA, 25 bp, Artificial Sequence
  probe sequence for 217336_at
tcatggtggccaaggacatccacat

SEQ ID NO: 1077 - DNA, 25 bp, Artificial Sequence
  probe sequence for 217336_at
gccaaggacatccacatgcctaagc

SEQ ID NO: 1078 - DNA, 25 bp, Artificial Sequence
  probe sequence for 217336_at
cctggagctgtcagacaagaatgtg

SEQ ID NO: 1079 - DNA, 25 bp, Artificial Sequence
  probe sequence for 217336_at
gtccaaccttcctgtcataaaggcc

SEQ ID NO: 1080 - DNA, 25 bp, Artificial Sequence
  probe sequence for 217336_at
aaccttcctgtcataaaggccatgc

SEQ ID NO: 1081 - DNA, 25 bp, Artificial Sequence
  probe sequence for 217336_at
tcctgtcataaaggccatgcagtct

SEQ ID NO: 1082 - DNA, 25 bp, Artificial Sequence
  probe sequence for 217336_at
gaagggtgagtgacctgcaagactc

SEQ ID NO: 1083 - DNA, 25 bp, Artificial Sequence
  probe sequence for 217336_at
agggaaagccgacagagatacctac

SEQ ID NO: 1084 - DNA, 25 bp, Artificial Sequence
  probe sequence for 217336_at
gggactgggtcagcaactgaattcc

SEQ ID NO: 1085 - DNA, 25 bp, Artificial Sequence
  probe sequence for 203301_s_at
gtaacaaaacccaccagaatctaag

SEQ ID NO: 1086 - DNA, 25 bp, Artificial Sequence
  probe sequence for 203301_s_at
cagaatctaagcagttttcaccccc

SEQ ID NO: 1087 - DNA, 25 bp, Artificial Sequence
  probe sequence for 203301_s_at
ccccctcagaaaccactgtcattag

SEQ ID NO: 1088 - DNA, 25 bp, Artificial Sequence
  probe sequence for 203301_s_at
agtaatgttacctatccttgatacc

SEQ ID NO: 1089 - DNA, 25 bp, Artificial Sequence
  probe sequence for 203301_s_at
ctatccttgataccatgaccattta

SEQ ID NO: 1090 - DNA, 25 bp, Artificial Sequence
  probe sequence for 203301_s_at
gaatagtttgtcatccacttagtgt

SEQ ID NO: 1091 - DNA, 25 bp, Artificial Sequence
  probe sequence for 203301_s_at
cttagtgtgttagctggtggggtac

SEQ ID NO: 1092 - DNA, 25 bp, Artificial Sequence
  probe sequence for 203301_s_at
ggggtacaatataacctctcatctc

SEQ ID NO: 1093 - DNA, 25 bp, Artificial Sequence
  probe sequence for 203301_s_at
ctaagaatcattcctgtactacaga

SEQ ID NO: 1094 - DNA, 25 bp, Artificial Sequence
  probe sequence for 203301_s_at
gatcttcacaaagttgtcttttcac

SEQ ID NO: 1095 - DNA, 25 bp, Artificial Sequence
  probe sequence for 203301_s_at
cactgtgttttgtcaacgtgaaatt

SEQ ID NO: 1096 - DNA, 25 bp, Artificial Sequence
  probe sequence for 207283_at
tttcaaacccagtagagttacctca

SEQ ID NO: 1097 - DNA, 25 bp, Artificial Sequence
  probe sequence for 207283_at
aacccagtagagttacctcaaagat

SEQ ID NO: 1098 - DNA, 25 bp, Artificial Sequence
  probe sequence for 207283_at
tttcagaagatggcaccgaaagtga

SEQ ID NO: 1099 - DNA, 25 bp, Artificial Sequence
  probe sequence for 207283_at
gcaccgaaagtgaagaaggaagctc

SEQ ID NO: 1100 - DNA, 25 bp, Artificial Sequence
  probe sequence for 207283_at
ccactgagtttgctatgaagaagat

SEQ ID NO: 1101 - DNA, 25 bp, Artificial Sequence
  probe sequence for 207283_at
gctctgtgacattgatggggccaag

SEQ ID NO: 1102 - DNA, 25 bp, Artificial Sequence
  probe sequence for 207283_at
ctgtgacattgatggggccaaggtc

SEQ ID NO: 1103 - DNA, 25 bp, Artificial Sequence
  probe sequence for 207283_at
gatgaaggcatatgttccactggct

SEQ ID NO: 1104 - DNA, 25 bp, Artificial Sequence
  probe sequence for 207283_at
gatcatccaaactgagtccatctgg

SEQ ID NO: 1105 - DNA, 25 bp, Artificial Sequence
  probe sequence for 207283_at
aactgagtccatctggctaattcta

SEQ ID NO: 1106 - DNA, 25 bp, Artificial Sequence
  probe sequence for 207283_at
gtccatctggctaattctaaatata

SEQ ID NO: 1107 - DNA, 25 bp, Artificial Sequence
  probe sequence for 222168_at
aattcacttattttcatgggttctg

SEQ ID NO: 1108 - DNA, 25 bp, Artificial Sequence
  probe sequence for 222168_at
gacctaaaaatctcaatggcaccta

SEQ ID NO: 1109 - DNA, 25 bp, Artificial Sequence
  probe sequence for 222168_at
ctaaaaatctcaatggcacctacca

SEQ ID NO: 1110 - DNA, 25 bp, Artificial Sequence
  probe sequence for 222168_at
ctaacacatagtaggggctctacat

SEQ ID NO: 1111 - DNA, 25 bp, Artificial Sequence
  probe sequence for 222168_at
gtaggggctctacatgattatctgt

SEQ ID NO: 1112 - DNA, 25 bp, Artificial Sequence
  probe sequence for 222168_at
ggctctacatgattatctgtaattg

SEQ ID NO: 1113 - DNA, 25 bp, Artificial Sequence
  probe sequence for 222168_at
ggaggtgatggttttcctatttgat

SEQ ID NO: 1114 - DNA, 25 bp, Artificial Sequence
  probe sequence for 222168_at
gcaacatagttctaagccagtggtt

SEQ ID NO: 1115 - DNA, 25 bp, Artificial Sequence
  probe sequence for 222168_at
tggttctccaacttgagtatgcatc

SEQ ID NO: 1116 - DNA, 25 bp, Artificial Sequence
  probe sequence for 222168_at
tctccaacttgagtatgcatcagaa

SEQ ID NO: 1117 - DNA, 25 bp, Artificial Sequence
  probe sequence for 222168_at
aaaatacagatgtctgccgggcgcg

SEQ ID NO: 1118 - DNA, 25 bp, Artificial Sequence
  probe sequence for 222272_x_at
taaaacagggccatgagccacccac

SEQ ID NO: 1119 - DNA, 25 bp, Artificial Sequence
  probe sequence for 222272_x_at
cattcacaggctggttcctgggctg

SEQ ID NO: 1120 - DNA, 25 bp, Artificial Sequence
  probe sequence for 222272_x_at
ggcagttatctcattgctgttttgg

SEQ ID NO: 1121 - DNA, 25 bp, Artificial Sequence
  probe sequence for 222272_x_at
gctttttgcttatttgtcttttgaa

SEQ ID NO: 1122 - DNA, 25 bp, Artificial Sequence
  probe sequence for 222272_x_at
tgaggtaggcggatcactggggtca

SEQ ID NO: 1123 - DNA, 25 bp, Artificial Sequence
  probe sequence for 222272_x_at
aattagctgcgcgtggtggtgcacg

SEQ ID NO: 1124 - DNA, 25 bp, Artificial Sequence
  probe sequence for 222272_x_at
cctgtagtccctgctacttggaagg

SEQ ID NO: 1125 - DNA, 25 bp, Artificial Sequence
  probe sequence for 222272_x_at
gacgcggccgcgaatttagtagtag

SEQ ID NO: 1126 - DNA, 25 bp, Artificial Sequence
  probe sequence for 222272_x_at
gtagtagtaggcggccgctctagag

SEQ ID NO: 1127 - DNA, 25 bp, Artificial Sequence
  probe sequence for 222272_x_at
agaggatccaagcttacgtacgcgt

SEQ ID NO: 1128 - DNA, 25 bp, Artificial Sequence
  probe sequence for 222272_x_at
tacgcgtgcatgcgacgtcatagct

SEQ ID NO: 1129 - DNA, 25 bp, Artificial Sequence
  probe sequence for 219290_x_at
agaagttactggccaggagcggcgg

SEQ ID NO: 1130 - DNA, 25 bp, Artificial Sequence
  probe sequence for 219290_x_at
gtaatcccaggactttggtaggcca

SEQ ID NO: 1131 - DNA, 25 bp, Artificial Sequence
  probe sequence for 219290_x_at
ggtaggccaagacaagcagatcact

SEQ ID NO: 1132 - DNA, 25 bp, Artificial Sequence
  probe sequence for 219290_x_at
caggagttcaacatcagcctggcca

SEQ ID NO: 1133 - DNA, 25 bp, Artificial Sequence
  probe sequence for 219290_x_at
ggccaacatgatgaaaccttgtctt

SEQ ID NO: 1134 - DNA, 25 bp, Artificial Sequence
  probe sequence for 219290_x_at
tgcagtgaaccaagatcgcggcgct

SEQ ID NO: 1135 - DNA, 25 bp, Artificial Sequence
  probe sequence for 219290_x_at
ggtgacagagtcagactccgtccca

SEQ ID NO: 1136 - DNA, 25 bp, Artificial Sequence
  probe sequence for 219290_x_at
tatagttttatgtttgttttcttag

SEQ ID NO: 1137 - DNA, 25 bp, Artificial Sequence
  probe sequence for 219290_x_at
atgtgtttctttgggtgggtaatat

SEQ ID NO: 1138 - DNA, 25 bp, Artificial Sequence
  probe sequence for 219290_x_at
tattgtgttttactatgtttacctt

SEQ ID NO: 1139 - DNA, 25 bp, Artificial Sequence
  probe sequence for 219290_x_at
gtttatttatattctttggctttgt

SEQ ID NO: 1140 - DNA, 25 bp, Artificial Sequence
  probe sequence for 204119_s_at
aaaggtggctcaccatgcttctgaa

SEQ ID NO: 1141 - DNA, 25 bp, Artificial Sequence
  probe sequence for 204119_s_at
actttgaatctatctgcaccgttta

SEQ ID NO: 1142 - DNA, 25 bp, Artificial Sequence
  probe sequence for 204119_s_at
gcaccgtttattagccagttctaca

SEQ ID NO: 1143 - DNA, 25 bp, Artificial Sequence
  probe sequence for 204119_s_at
acagaagctgccacttttgctagag

SEQ ID NO: 1144 - DNA, 25 bp, Artificial Sequence
  probe sequence for 204119_s_at
gacacaagccctgccaaagatgaac

SEQ ID NO: 1145 - DNA, 25 bp, Artificial Sequence
  probe sequence for 204119_s_at
aggcagcgaatcgtgatcttcaccc

SEQ ID NO: 1146 - DNA, 25 bp, Artificial Sequence
  probe sequence for 204119_s_at
ttggaggttttctgtctcaactggt

SEQ ID NO: 1147 - DNA, 25 bp, Artificial Sequence
  probe sequence for 204119_s_at
caactggtctctgacaagcctctga

SEQ ID NO: 1148 - DNA, 25 bp, Artificial Sequence
  probe sequence for 204119_s_at
gcctctgactgaatgtatccgtgct

SEQ ID NO: 1149 - DNA, 25 bp, Artificial Sequence
  probe sequence for 204119_s_at
tatccgtgctggccactatgcagca

SEQ ID NO: 1150 - DNA, 25 bp, Artificial Sequence
  probe sequence for 204119_s_at
taattagacggactggctgcacctt

SEQ ID NO: 1151 - DNA, 25 bp, Artificial Sequence
  probe sequence for 215204_at
catggtgaaaccctaactctccaaa

SEQ ID NO: 1152 - DNA, 25 bp, Artificial Sequence
  probe sequence for 215204_at
tatggaggacttccttacaactttt

SEQ ID NO: 1153 - DNA, 25 bp, Artificial Sequence
  probe sequence for 215204_at
attactgtactggtacgtgcttttt

SEQ ID NO: 1154 - DNA, 25 bp, Artificial Sequence
  probe sequence for 215204_at
gtactggtacgtgctttttatatat

SEQ ID NO: 1155 - DNA, 25 bp, Artificial Sequence
  probe sequence for 215204_at
ttatatatttgatctatttctttgc

SEQ ID NO: 1156 - DNA, 25 bp, Artificial Sequence
  probe sequence for 215204_at
tctatttctttgcatcagatcccta

SEQ ID NO: 1157 - DNA, 25 bp, Artificial Sequence
  probe sequence for 215204_at
atttctttgcatcagatccctagaa

SEQ ID NO: 1158 - DNA, 25 bp, Artificial Sequence
  probe sequence for 215204_at
tgatatacagatttttaagacttga

SEQ ID NO: 1159 - DNA, 25 bp, Artificial Sequence
  probe sequence for 215204_at
taagacttgatacgttaatgccaaa

SEQ ID NO: 1160 - DNA, 25 bp, Artificial Sequence
  probe sequence for 215204_at
gatacgttaatgccaaaatgccttg

SEQ ID NO: 1161 - DNA, 25 bp, Artificial Sequence
  probe sequence for 215204_at
aaaatgccttgtgtggccaggcgcg

SEQ ID NO: 1162 - DNA, 25 bp, Artificial Sequence
  probe sequence for 215387_x_at
gcgatgggcaggtagaagggaatga

SEQ ID NO: 1163 - DNA, 25 bp, Artificial Sequence
  probe sequence for 215387_x_at
gggaatgagatgggccaggcgcagt

SEQ ID NO: 1164 - DNA, 25 bp, Artificial Sequence
  probe sequence for 215387_x_at
gcactttaggaggccgaggctggca

SEQ ID NO: 1165 - DNA, 25 bp, Artificial Sequence
  probe sequence for 215387_x_at
gccgaggctggcagatcagaaggcc

SEQ ID NO: 1166 - DNA, 25 bp, Artificial Sequence
  probe sequence for 215387_x_at
aaattagctgggcacgggggcatgc

SEQ ID NO: 1167 - DNA, 25 bp, Artificial Sequence
  probe sequence for 215387_x_at
tggttgatgagtctttagggagttc

SEQ ID NO: 1168 - DNA, 25 bp, Artificial Sequence
  probe sequence for 215387_x_at
gttcatagactattctgggttgtgt

SEQ ID NO: 1169 - DNA, 25 bp, Artificial Sequence
  probe sequence for 215387_x_at
ggttgtgtatagtttctgaatttcc

SEQ ID NO: 1170 - DNA, 25 bp, Artificial Sequence
  probe sequence for 215387_x_at
gagagaaagagagttggccagcaca

SEQ ID NO: 1171 - DNA, 25 bp, Artificial Sequence
  probe sequence for 215387_x_at
agagagttggccagcacagtgcctc

SEQ ID NO: 1172 - DNA, 25 bp, Artificial Sequence
  probe sequence for 215387_x_at
ttgggatgctgaggtgggcggatca

SEQ ID NO: 1173 - DNA, 25 bp, Artificial Sequence
  probe sequence for 222358_x_at
ttagtggctggacatggtggctcat

SEQ ID NO: 1174 - DNA, 25 bp, Artificial Sequence
  probe sequence for 222358_x_at
catgcctctaattccagcacattgt

SEQ ID NO: 1175 - DNA, 25 bp, Artificial Sequence
  probe sequence for 222358_x_at
gaggatagctttaacccaggagttc

SEQ ID NO: 1176 - DNA, 25 bp, Artificial Sequence
  probe sequence for 222358_x_at
gaggctgcagtcagctgtgttcaca

SEQ ID NO: 1177 - DNA, 25 bp, Artificial Sequence
  probe sequence for 222358_x_at
gatttattccttttttaccatgtca

SEQ ID NO: 1178 - DNA, 25 bp, Artificial Sequence
  probe sequence for 222358_x_at
atattgctgcttttcctagagggag

SEQ ID NO: 1179 - DNA, 25 bp, Artificial Sequence
  probe sequence for 222358_x_at
gtcatgattactactggatccacag

SEQ ID NO: 1180 - DNA, 25 bp, Artificial Sequence
  probe sequence for 222358_x_at
gacgcggccgcgaatttagtagtag

SEQ ID NO: 1181 - DNA, 25 bp, Artificial Sequence
  probe sequence for 222358_x_at
gtagtagtaggcggccgctctagag

SEQ ID NO: 1182 - DNA, 25 bp, Artificial Sequence
  probe sequence for 222358_x_at
agaggatccaagcttacgtacgcgt

SEQ ID NO: 1183 - DNA, 25 bp, Artificial Sequence
  probe sequence for 222358_x_at
tacgtacgcgtgcatgcgacgtcat

SEQ ID NO: 1184 - DNA, 25 bp, Artificial Sequence
  probe sequence for 218735_s_at
aagcttccagttatgatactttcct

SEQ ID NO: 1185 - DNA, 25 bp, Artificial Sequence
  probe sequence for 218735_s_at
atgatactttccttattcaacatga

SEQ ID NO: 1186 - DNA, 25 bp, Artificial Sequence
  probe sequence for 218735_s_at
aagatggagccgggtgcagttgcca

SEQ ID NO: 1187 - DNA, 25 bp, Artificial Sequence
  probe sequence for 218735_s_at
atcacaccgctgccttgtgagagat

SEQ ID NO: 1188 - DNA, 25 bp, Artificial Sequence
  probe sequence for 218735_s_at
gatgggaaatttccctgccagacct

SEQ ID NO: 1189 - DNA, 25 bp, Artificial Sequence
  probe sequence for 218735_s_at
caggtggccaaaacatgactctcag

SEQ ID NO: 1190 - DNA, 25 bp, Artificial Sequence
  probe sequence for 218735_s_at
ctctcagagtggggcttcatgacca

SEQ ID NO: 1191 - DNA, 25 bp, Artificial Sequence
  probe sequence for 218735_s_at
gggcttcatgaccatgtgcatcaga

SEQ ID NO: 1192 - DNA, 25 bp, Artificial Sequence
  probe sequence for 218735_s_at
cagaattgcctggagtgtgcactga

SEQ ID NO: 1193 - DNA, 25 bp, Artificial Sequence
  probe sequence for 218735_s_at
aactgtgtattaccaagctcactct

SEQ ID NO: 1194 - DNA, 25 bp, Artificial Sequence
  probe sequence for 218735_s_at
taccaagctcactctagccaactaa

SEQ ID NO: 1195 - DNA, 25 bp, Artificial Sequence
  probe sequence for 200078_s_at
ccaaggccatcggccatcggaacta

SEQ ID NO: 1196 - DNA, 25 bp, Artificial Sequence
  probe sequence for 200078_s_at
atcggaactaccatgcaggctactc

SEQ ID NO: 1197 - DNA, 25 bp, Artificial Sequence
  probe sequence for 200078_s_at
tgcaggctactccatgtttggggct

SEQ ID NO: 1198 - DNA, 25 bp, Artificial Sequence
  probe sequence for 200078_s_at
gtctaacctcttctgtggagtctgc

SEQ ID NO: 1199 - DNA, 25 bp, Artificial Sequence
  probe sequence for 200078_s_at
agtctgcgtgggcatcgtgggcagt

SEQ ID NO: 1200 - DNA, 25 bp, Artificial Sequence
  probe sequence for 200078_s_at
catcgtggagatctttggcagcgcc

SEQ ID NO: 1201 - DNA, 25 bp, Artificial Sequence
  probe sequence for 200078_s_at
gtcatcgtcgcaattcttcagacct

SEQ ID NO: 1202 - DNA, 25 bp, Artificial Sequence
  probe sequence for 200078_s_at
ccctcttgctgcgtgttgatttgga

SEQ ID NO: 1203 - DNA, 25 bp, Artificial Sequence
  probe sequence for 200078_s_at
gatttggaggcactgcagtccaggc

SEQ ID NO: 1204 - DNA, 25 bp, Artificial Sequence
  probe sequence for 200078_s_at
tgctgctgactctgtgcagctgcgc

SEQ ID NO: 1205 - DNA, 25 bp, Artificial Sequence
  probe sequence for 200078_s_at
tcaacccatcttcctagtgtttgtg

SEQ ID NO: 1206 - DNA, 25 bp, Artificial Sequence
  probe sequence for 205010_at
gctctggcatctgccctgaaaaata

SEQ ID NO: 1207 - DNA, 25 bp, Artificial Sequence
  probe sequence for 205010_at
gaaacgtgcagataaaatcgccagc

SEQ ID NO: 1208 - DNA, 25 bp, Artificial Sequence
  probe sequence for 205010_at
agataaaatcgccagcaagctgtct

SEQ ID NO: 1209 - DNA, 25 bp, Artificial Sequence
  probe sequence for 205010_at
atcgccagcaagctgtctgattcca

SEQ ID NO: 1210 - DNA, 25 bp, Artificial Sequence
  probe sequence for 205010_at
gatggtgttggtgactaatcgactg

SEQ ID NO: 1211 - DNA, 25 bp, Artificial Sequence
  probe sequence for 205010_at
ggtgttggtgactaatcgactgatc

SEQ ID NO: 1212 - DNA, 25 bp, Artificial Sequence
  probe sequence for 205010_at
gtgactaatcgactgatctcacttc

SEQ ID NO: 1213 - DNA, 25 bp, Artificial Sequence
  probe sequence for 205010_at
ccaagcaccagttccggtggtacgg

SEQ ID NO: 1214 - DNA, 25 bp, Artificial Sequence
  probe sequence for 205010_at
gtacgggggaataccagtgaaatag

SEQ ID NO: 1215 - DNA, 25 bp, Artificial Sequence
  probe sequence for 205010_at
aagcatctgcatattgaaagaacgc

SEQ ID NO: 1216 - DNA, 25 bp, Artificial Sequence
  probe sequence for 205010_at
attgaaagaacgctttccccactgt

SEQ ID NO: 1217 - DNA, 25 bp, Artificial Sequence
  probe sequence for 203455_s_at
tgaggtctgtttaaagtggcaatct

SEQ ID NO: 1218 - DNA, 25 bp, Artificial Sequence
  probe sequence for 203455_s_at
gtggcaatctcagatgcagtttgga

SEQ ID NO: 1219 - DNA, 25 bp, Artificial Sequence
  probe sequence for 203455_s_at
agagtcagatctttctccttgaata

SEQ ID NO: 1220 - DNA, 25 bp, Artificial Sequence
  probe sequence for 203455_s_at
gatctttctccttgaatatctttcg

SEQ ID NO: 1221 - DNA, 25 bp, Artificial Sequence
  probe sequence for 203455_s_at
tttctccttgaatatctttcgataa

SEQ ID NO: 1222 - DNA, 25 bp, Artificial Sequence
  probe sequence for 203455_s_at
ggtggtgtgatcttaatatatttga

SEQ ID NO: 1223 - DNA, 25 bp, Artificial Sequence
  probe sequence for 203455_s_at
aaaaaacttcattctcgtgagtcat

SEQ ID NO: 1224 - DNA, 25 bp, Artificial Sequence
  probe sequence for 203455_s_at
attctcgtgagtcatttaaatgtgt

SEQ ID NO: 1225 - DNA, 25 bp, Artificial Sequence
  probe sequence for 203455_s_at
tgtacaatgtacacactggtactta

SEQ ID NO: 1226 - DNA, 25 bp, Artificial Sequence
  probe sequence for 203455_s_at
acacactggtacttagagtttctgt

SEQ ID NO: 1227 - DNA, 25 bp, Artificial Sequence
  probe sequence for 203455_s_at
gtacttagagtttctgtttgattct

SEQ ID NO: 1228 - DNA, 25 bp, Artificial Sequence
  probe sequence for 1316_at
gtgttctgcagttcccaggacccca

SEQ ID NO: 1229 - DNA, 25 bp, Artificial Sequence
  probe sequence for 1316_at
gacaagccaccttgaccgtagggaa

SEQ ID NO: 1230 - DNA, 25 bp, Artificial Sequence
  probe sequence for 1316_at
cccctacacacacatgagagagagc

SEQ ID NO: 1231 - DNA, 25 bp, Artificial Sequence
  probe sequence for 1316_at
ctacacacacatgagagagagcccc

SEQ ID NO: 1232 - DNA, 25 bp, Artificial Sequence
  probe sequence for 1316_at
ccacccagttccttggcctaggtct

SEQ ID NO: 1233 - DNA, 25 bp, Artificial Sequence
  probe sequence for 1316_at
agatgcctgggtgcaaagaacggct

SEQ ID NO: 1234 - DNA, 25 bp, Artificial Sequence
  probe sequence for 1316_at
tgcctgggtgcaaagaacggcttgg

SEQ ID NO: 1235 - DNA, 25 bp, Artificial Sequence
  probe sequence for 1316_at
gcaaagaacggcttggcttggctcc

SEQ ID NO: 1236 - DNA, 25 bp, Artificial Sequence
  probe sequence for 1316_at
ttggcttggctcctcctctggagtt

SEQ ID NO: 1237 - DNA, 25 bp, Artificial Sequence
  probe sequence for 1316_at
gcttggctcctcctctggagttaaa

SEQ ID NO: 1238 - DNA, 25 bp, Artificial Sequence
  probe sequence for 1316_at
aatttatagtcattctaactgcact

SEQ ID NO: 1239 - DNA, 25 bp, Artificial Sequence
  probe sequence for 1316_at
tagtcattctaactgcactttggaa

SEQ ID NO: 1240 - DNA, 25 bp, Artificial Sequence
  probe sequence for 1316_at
tcattctaactgcactttggaaacc

SEQ ID NO: 1241 - DNA, 25 bp, Artificial Sequence
  probe sequence for 1316_at
ttctaactgcactttggaaaccaag

SEQ ID NO: 1242 - DNA, 25 bp, Artificial Sequence
  probe sequence for 1316_at
ctgcactttggaaaccaagcaaggg

SEQ ID NO: 1243 - DNA, 25 bp, Artificial Sequence
  probe sequence for 1316_at
cactttggaaaccaagcaaggggag

SEQ ID NO: 1244 - DNA, 25 bp, Artificial Sequence
  probe sequence for 212227_x_at
agcaataccgtcatgtttcagccaa

SEQ ID NO: 1245 - DNA, 25 bp, Artificial Sequence
  probe sequence for 212227_x_at
caagcccagagccctaagattacaa

SEQ ID NO: 1246 - DNA, 25 bp, Artificial Sequence
  probe sequence for 212227_x_at
cagagttccctaccctaagagaatg

SEQ ID NO: 1247 - DNA, 25 bp, Artificial Sequence
  probe sequence for 212227_x_at
gttaccacctgaacagtcctcggtg

SEQ ID NO: 1248 - DNA, 25 bp, Artificial Sequence
  probe sequence for 212227_x_at
ggcagaagcaccagctgtactacta

SEQ ID NO: 1249 - DNA, 25 bp, Artificial Sequence
  probe sequence for 212227_x_at
ggtgtctccaacctgactaggtgga

SEQ ID NO: 1250 - DNA, 25 bp, Artificial Sequence
  probe sequence for 212227_x_at
gtgataggacatctggcttgccaca

SEQ ID NO: 1251 - DNA, 25 bp, Artificial Sequence
  probe sequence for 212227_x_at
gcttgccacaaaggtctgttcgacc

SEQ ID NO: 1252 - DNA, 25 bp, Artificial Sequence
  probe sequence for 212227_x_at
gttcgaccagacatatcctagctaa

SEQ ID NO: 1253 - DNA, 25 bp, Artificial Sequence
  probe sequence for 212227_x_at
gaatgtgaggccaaccttctatcag

SEQ ID NO: 1254 - DNA, 25 bp, Artificial Sequence
  probe sequence for 212227_x_at
cagctgcccaatgccatgtgaagta

SEQ ID NO: 1255 - DNA, 25 bp, Artificial Sequence
  probe sequence for 216187_x_at
ggagttcaagatcaaccaacatagc

SEQ ID NO: 1256 - DNA, 25 bp, Artificial Sequence
  probe sequence for 216187_x_at
caaccaacatagcaagaccctgtct

SEQ ID NO: 1257 - DNA, 25 bp, Artificial Sequence
  probe sequence for 216187_x_at
taagctacctaaagtgttatgagaa

SEQ ID NO: 1258 - DNA, 25 bp, Artificial Sequence
  probe sequence for 216187_x_at
aatgaggccggacatggtggctcac

SEQ ID NO: 1259 - DNA, 25 bp, Artificial Sequence
  probe sequence for 216187_x_at
aatcccaacactttgcgaggctaag

SEQ ID NO: 1260 - DNA, 25 bp, Artificial Sequence
  probe sequence for 216187_x_at
tgcgaggctaaggcgggtgggtcac

SEQ ID NO: 1261 - DNA, 25 bp, Artificial Sequence
  probe sequence for 216187_x_at
gaccagcctgaccaagaatgataag

SEQ ID NO: 1262 - DNA, 25 bp, Artificial Sequence
  probe sequence for 216187_x_at
gaatgataagaccctgtctctacta

SEQ ID NO: 1263 - DNA, 25 bp, Artificial Sequence
  probe sequence for 216187_x_at
ccaactactagggaggctgaggcag

SEQ ID NO: 1264 - DNA, 25 bp, Artificial Sequence
  probe sequence for 216187_x_at
cagaggttgcaatgagccaagatga

SEQ ID NO: 1265 - DNA, 25 bp, Artificial Sequence
  probe sequence for 216187_x_at
agatgatgccattgcatgccagccc

SEQ ID NO: 1266 - DNA, 25 bp, Artificial Sequence
  probe sequence for 208678_at
gatgatgccagaagtccggggagcc

SEQ ID NO: 1267 - DNA, 25 bp, Artificial Sequence
  probe sequence for 208678_at
ttcaggaggtggagctcgtcgtcag

SEQ ID NO: 1268 - DNA, 25 bp, Artificial Sequence
  probe sequence for 208678_at
aacacgaatgtctctgtagcttcct

SEQ ID NO: 1269 - DNA, 25 bp, Artificial Sequence
  probe sequence for 208678_at
ctgccccagtattgctctgtattta

SEQ ID NO: 1270 - DNA, 25 bp, Artificial Sequence
  probe sequence for 208678_at
tctgtatttatcagcgatgcccctc

SEQ ID NO: 1271 - DNA, 25 bp, Artificial Sequence
  probe sequence for 208678_at
aagtgtgacagtgtccagccggttc

SEQ ID NO: 1272 - DNA, 25 bp, Artificial Sequence
  probe sequence for 208678_at
actctccgtctggcctaaaggtgat

SEQ ID NO: 1273 - DNA, 25 bp, Artificial Sequence
  probe sequence for 208678_at
tgtatttggtgtttggccctgcagt

SEQ ID NO: 1274 - DNA, 25 bp, Artificial Sequence
  probe sequence for 208678_at
tccccactcttgaggcttaaggcgc

SEQ ID NO: 1275 - DNA, 25 bp, Artificial Sequence
  probe sequence for 208678_at
ttaaggcgcatgtggcacaccactc

SEQ ID NO: 1276 - DNA, 25 bp, Artificial Sequence
  probe sequence for 208678_at
gtcgctttactgttacctgtttagg

SEQ ID NO: 1277 - DNA, 25 bp, Artificial Sequence
  probe sequence for 222310_at
acaaggtatatttctctcacataac

SEQ ID NO: 1278 - DNA, 25 bp, Artificial Sequence
  probe sequence for 222310_at
caccatttatatcactcaacttgag

SEQ ID NO: 1279 - DNA, 25 bp, Artificial Sequence
  probe sequence for 222310_at
ttatggaaattatcacttctgtatc

SEQ ID NO: 1280 - DNA, 25 bp, Artificial Sequence
  probe sequence for 222310_at
ttctgtggattgttcattatgtcgt

SEQ ID NO: 1281 - DNA, 25 bp, Artificial Sequence
  probe sequence for 222310_at
gattgttcattatgtcgttttgtaa

SEQ ID NO: 1282 - DNA, 25 bp, Artificial Sequence
  probe sequence for 222310_at
gtaatttgagagattttccccctca

SEQ ID NO: 1283 - DNA, 25 bp, Artificial Sequence
  probe sequence for 222310_at
gaaaacatcgattattttccctggt

SEQ ID NO: 1284 - DNA, 25 bp, Artificial Sequence
  probe sequence for 222310_at
tgtgatatgtgctcagtgcaaaaat

SEQ ID NO: 1285 - DNA, 25 bp, Artificial Sequence
  probe sequence for 222310_at
atgtgctcagtgcaaaaatttccag

SEQ ID NO: 1286 - DNA, 25 bp, Artificial Sequence
  probe sequence for 222310_at
gcaaaaatttccagggtttgaagct

SEQ ID NO: 1287 - DNA, 25 bp, Artificial Sequence
  probe sequence for 222310_at
agggtttgaagctgaatttactagt

SEQ ID NO: 1288 - DNA, 25 bp, Artificial Sequence
  probe sequence for 210434_x_at
atggcctggggctggcatttatctt

SEQ ID NO: 1289 - DNA, 25 bp, Artificial Sequence
  probe sequence for 210434_x_at
ttatctttcctttcagcaagcacct

SEQ ID NO: 1290 - DNA, 25 bp, Artificial Sequence
  probe sequence for 210434_x_at
gcacctcaaatttgccatgctggct

SEQ ID NO: 1291 - DNA, 25 bp, Artificial Sequence
  probe sequence for 210434_x_at
aagagtgctctccatgctctaattt

SEQ ID NO: 1292 - DNA, 25 bp, Artificial Sequence
  probe sequence for 210434_x_at
tacccctgagtgtggtcccacagga

SEQ ID NO: 1293 - DNA, 25 bp, Artificial Sequence
  probe sequence for 210434_x_at
ctgccgctcagctttgatggaacaa

SEQ ID NO: 1294 - DNA, 25 bp, Artificial Sequence
  probe sequence for 210434_x_at
gaaggggctgtcgtgtgtgtggccc

SEQ ID NO: 1295 - DNA, 25 bp, Artificial Sequence
  probe sequence for 210434_x_at
ttgtcttgtcatcattcgtcagcga

SEQ ID NO: 1296 - DNA, 25 bp, Artificial Sequence
  probe sequence for 210434_x_at
tcgagtccatatagctacattccac

SEQ ID NO: 1297 - DNA, 25 bp, Artificial Sequence
  probe sequence for 210434_x_at
ccacccttgtatcctgggtcttaga

SEQ ID NO: 1298 - DNA, 25 bp, Artificial Sequence
  probe sequence for 210434_x_at
tgatttgcactcttggttctttgga

SEQ ID NO: 1299 - DNA, 25 bp, Artificial Sequence
  probe sequence for 222282_at
gttgacagactcttgttttctggag

SEQ ID NO: 1300 - DNA, 25 bp, Artificial Sequence
  probe sequence for 222282_at
tggaggttaaccttgtctctggtcc

SEQ ID NO: 1301 - DNA, 25 bp, Artificial Sequence
  probe sequence for 222282_at
ttgtccacaatctgttatgaaccct

SEQ ID NO: 1302 - DNA, 25 bp, Artificial Sequence
  probe sequence for 222282_at
tatgaaccctggactggtgagcctt

SEQ ID NO: 1303 - DNA, 25 bp, Artificial Sequence
  probe sequence for 222282_at
gtgagccttgttatctgtggccaac

SEQ ID NO: 1304 - DNA, 25 bp, Artificial Sequence
  probe sequence for 222282_at
atctgtggccaacctagggaatttt

SEQ ID NO: 1305 - DNA, 25 bp, Artificial Sequence
  probe sequence for 222282_at
tgttgtctctcatagtttttccagc

SEQ ID NO: 1306 - DNA, 25 bp, Artificial Sequence
  probe sequence for 222282_at
cctcctagtcacaatccccagaggc

SEQ ID NO: 1307 - DNA, 25 bp, Artificial Sequence
  probe sequence for 222282_at
atccccagaggcagctacttcaatt

SEQ ID NO: 1308 - DNA, 25 bp, Artificial Sequence
  probe sequence for 222282_at
cttcaattcttctggctacctagtt

SEQ ID NO: 1309 - DNA, 25 bp, Artificial Sequence
  probe sequence for 222282_at
ggctacctagttttactttactctg

SEQ ID NO: 1310 - DNA, 25 bp, Artificial Sequence
  probe sequence for 219678_x_at
tgagaagctggcaactggtgagagt

SEQ ID NO: 1311 - DNA, 25 bp, Artificial Sequence
  probe sequence for 219678_x_at
gaaaatgctcactcttagataccta

SEQ ID NO: 1312 - DNA, 25 bp, Artificial Sequence
  probe sequence for 219678_x_at
aagcgtttcaacctagagcaaccac

SEQ ID NO: 1313 - DNA, 25 bp, Artificial Sequence
  probe sequence for 219678_x_at
caaccactaaaaaacctgcacagag

SEQ ID NO: 1314 - DNA, 25 bp, Artificial Sequence
  probe sequence for 219678_x_at
taacctggttgggtgtggtggctca

SEQ ID NO: 1315 - DNA, 25 bp, Artificial Sequence
  probe sequence for 219678_x_at
ccagcactttgaggtgggcaatggc

SEQ ID NO: 1316 - DNA, 25 bp, Artificial Sequence
  probe sequence for 219678_x_at
ggtgggcaatggcttgagcccagga

SEQ ID NO: 1317 - DNA, 25 bp, Artificial Sequence
  probe sequence for 219678_x_at
acagtgaaatgtgtctctacttaca

SEQ ID NO: 1318 - DNA, 25 bp, Artificial Sequence
  probe sequence for 219678_x_at
atggtggtgggctactctggaggcc

SEQ ID NO: 1319 - DNA, 25 bp, Artificial Sequence
  probe sequence for 219678_x_at
ccactgcacctctagtctgggtgac

SEQ ID NO: 1320 - DNA, 25 bp, Artificial Sequence
  probe sequence for 219678_x_at
gagctgagattgtgtcattgcactc

SEQ ID NO: 1321 - DNA, 25 bp, Artificial Sequence
  probe sequence for 208268_at
tttcccctgtgcatgtgcgaaggaa

SEQ ID NO: 1322 - DNA, 25 bp, Artificial Sequence
  probe sequence for 208268_at
gatgacagtgtttaaccatggtcaa

SEQ ID NO: 1323 - DNA, 25 bp, Artificial Sequence
  probe sequence for 208268_at
tcctatccttcttagaagcttcgaa

SEQ ID NO: 1324 - DNA, 25 bp, Artificial Sequence
  probe sequence for 208268_at
gaagcttcgaactcaaaatcatgga

SEQ ID NO: 1325 - DNA, 25 bp, Artificial Sequence
  probe sequence for 208268_at
ttgttttttgtctcagcatcagtat

SEQ ID NO: 1326 - DNA, 25 bp, Artificial Sequence
  probe sequence for 208268_at
ttgtctcagcatcagtatatcccat

SEQ ID NO: 1327 - DNA, 25 bp, Artificial Sequence
  probe sequence for 208268_at
catcagtatatcccatgcaatattt

SEQ ID NO: 1328 - DNA, 25 bp, Artificial Sequence
  probe sequence for 208268_at
gaggtgtgctcatactaaaattatt

SEQ ID NO: 1329 - DNA, 25 bp, Artificial Sequence
  probe sequence for 208268_at
gcaaccctactaagatcataaaccc

SEQ ID NO: 1330 - DNA, 25 bp, Artificial Sequence
  probe sequence for 208268_at
cctactaagatcataaacccttgga

SEQ ID NO: 1331 - DNA, 25 bp, Artificial Sequence
  probe sequence for 208268_at
aacccttggaaatctgtgtgtgtgc

SEQ ID NO: 1332 - DNA, 25 bp, Artificial Sequence
  probe sequence for 220242_x_at
taatagttacaaatgcggtgagcac

SEQ ID NO: 1333 - DNA, 25 bp, Artificial Sequence
  probe sequence for 220242_x_at
cggtgagcacagcaaaccatcaagg

SEQ ID NO: 1334 - DNA, 25 bp, Artificial Sequence
  probe sequence for 220242_x_at
agaggattgggccaggcgtgtggct

SEQ ID NO: 1335 - DNA, 25 bp, Artificial Sequence
  probe sequence for 220242_x_at
ccagcactttaggagcccaaggtgg

SEQ ID NO: 1336 - DNA, 25 bp, Artificial Sequence
  probe sequence for 220242_x_at
tcatgagtttgagatcagcctggcc

SEQ ID NO: 1337 - DNA, 25 bp, Artificial Sequence
  probe sequence for 220242_x_at
agcctggccaacagacgtgagtcac

SEQ ID NO: 1338 - DNA, 25 bp, Artificial Sequence
  probe sequence for 220242_x_at
acagacgtgagtcacttttcccagc

SEQ ID NO: 1339 - DNA, 25 bp, Artificial Sequence
  probe sequence for 220242_x_at
cagcctgctttttgtttctttaaca

SEQ ID NO: 1340 - DNA, 25 bp, Artificial Sequence
  probe sequence for 220242_x_at
gaatctgaatcacattggcttatat

SEQ ID NO: 1341 - DNA, 25 bp, Artificial Sequence
  probe sequence for 220242_x_at
tttccaaaccatcaatgtgggttgt

SEQ ID NO: 1342 - DNA, 25 bp, Artificial Sequence
  probe sequence for 220242_x_at
gtgaaattctcagtttttttatgtt

SEQ ID NO: 1343 - DNA, 25 bp, Artificial Sequence
  probe sequence for 207287_at
ggctgtcagatggccttgagcggca

SEQ ID NO: 1344 - DNA, 25 bp, Artificial Sequence
  probe sequence for 207287_at
ggcaccaagtagaaaacgcgctccc

SEQ ID NO: 1345 - DNA, 25 bp, Artificial Sequence
  probe sequence for 207287_at
cttctcctcagcttcattgtgagac

SEQ ID NO: 1346 - DNA, 25 bp, Artificial Sequence
  probe sequence for 207287_at
tgtgagacctcaagttcctcagctt

SEQ ID NO: 1347 - DNA, 25 bp, Artificial Sequence
  probe sequence for 207287_at
gcttccaggatgatcaacctagctg

SEQ ID NO: 1348 - DNA, 25 bp, Artificial Sequence
  probe sequence for 207287_at
cccagccagggagaccaggtgttgt

SEQ ID NO: 1349 - DNA, 25 bp, Artificial Sequence
  probe sequence for 207287_at
gtgtgttctggatctctagaggggt

SEQ ID NO: 1350 - DNA, 25 bp, Artificial Sequence
  probe sequence for 207287_at
gatctctagaggggtttggtttggg

SEQ ID NO: 1351 - DNA, 25 bp, Artificial Sequence
  probe sequence for 207287_at
ggtttgggccaagtagtgcttagtt

SEQ ID NO: 1352 - DNA, 25 bp, Artificial Sequence
  probe sequence for 207287_at
tgctcagctgtcatatcctgcaagg

SEQ ID NO: 1353 - DNA, 25 bp, Artificial Sequence
  probe sequence for 207287_at
agaggaaagatgtgggccgtgcgcg

SEQ ID NO: 1354 - DNA, 25 bp, Artificial Sequence
  probe sequence for 221899_at
tattttcagcttaggtttttaccag

SEQ ID NO: 1355 - DNA, 25 bp, Artificial Sequence
  probe sequence for 221899_at
ctgaatgactgtaggcaagccgttt

SEQ ID NO: 1356 - DNA, 25 bp, Artificial Sequence
  probe sequence for 221899_at
gctttgagacctaatttctccatct

SEQ ID NO: 1357 - DNA, 25 bp, Artificial Sequence
  probe sequence for 221899_at
ttctccatctgttagaggtggtgat

SEQ ID NO: 1358 - DNA, 25 bp, Artificial Sequence
  probe sequence for 221899_at
taattatacttgccctacctgatca

SEQ ID NO: 1359 - DNA, 25 bp, Artificial Sequence
  probe sequence for 221899_at
tctgtaccattgttatgtagtccca

SEQ ID NO: 1360 - DNA, 25 bp, Artificial Sequence
  probe sequence for 221899_at
aatgctaatgttttccaaggcttaa

SEQ ID NO: 1361 - DNA, 25 bp, Artificial Sequence
  probe sequence for 221899_at
ttttctcattgatattgctctacaa

SEQ ID NO: 1362 - DNA, 25 bp, Artificial Sequence
  probe sequence for 221899_at
agcggacatgggtcaatttctgttt

SEQ ID NO: 1363 - DNA, 25 bp, Artificial Sequence
  probe sequence for 221899_at
gttcttaacctgggctacacttttg

SEQ ID NO: 1364 - DNA, 25 bp, Artificial Sequence
  probe sequence for 221899_at
gggctacacttttgaatttcttggg

SEQ ID NO: 1365 - DNA, 25 bp, Artificial Sequence
  probe sequence for 213721_at
gcacatgaacggctggagcaacggc

SEQ ID NO: 1366 - DNA, 25 bp, Artificial Sequence
  probe sequence for 213721_at
ctggagcaacggcagctacagcatg

SEQ ID NO: 1367 - DNA, 25 bp, Artificial Sequence
  probe sequence for 213721_at
gctacagcatgatgcaggaccagct

SEQ ID NO: 1368 - DNA, 25 bp, Artificial Sequence
  probe sequence for 213721_at
cctgcagtacaactccatgaccagc

SEQ ID NO: 1369 - DNA, 25 bp, Artificial Sequence
  probe sequence for 213721_at
ccagctcgcagacctacatgaacgg

SEQ ID NO: 1370 - DNA, 25 bp, Artificial Sequence
  probe sequence for 213721_at
gctccatgggttcggtggtcaagtc

SEQ ID NO: 1371 - DNA, 25 bp, Artificial Sequence
  probe sequence for 213721_at
ttcggtggtcaagtccgaggccagc

SEQ ID NO: 1372 - DNA, 25 bp, Artificial Sequence
  probe sequence for 213721_at
ctgcccctctcacacatgtgagggc

SEQ ID NO: 1373 - DNA, 25 bp, Artificial Sequence
  probe sequence for 213721_at
cacatgtgagggccggacagcgaac

SEQ ID NO: 1374 - DNA, 25 bp, Artificial Sequence
  probe sequence for 213721_at
gccggacagcgaactggagggggga

SEQ ID NO: 1375 - DNA, 25 bp, Artificial Sequence
  probe sequence for 213721_at
gcatggagaaaacccggtacgctca

SEQ ID NO: 1376 - DNA, 25 bp, Artificial Sequence
  probe sequence for 214718_at
gctgggcaatggagtcagattctct

SEQ ID NO: 1377 - DNA, 25 bp, Artificial Sequence
  probe sequence for 214718_at
ggagtcagattctctttcttaaaaa

SEQ ID NO: 1378 - DNA, 25 bp, Artificial Sequence
  probe sequence for 214718_at
actggatttccagttctctaatatt

SEQ ID NO: 1379 - DNA, 25 bp, Artificial Sequence
  probe sequence for 214718_at
gttctctaatattcttagtaccaca

SEQ ID NO: 1380 - DNA, 25 bp, Artificial Sequence
  probe sequence for 214718_at
ttagtaccacaagatatgtcatagg

SEQ ID NO: 1381 - DNA, 25 bp, Artificial Sequence
  probe sequence for 214718_at
gaaattcttagctggaaaagtgact

SEQ ID NO: 1382 - DNA, 25 bp, Artificial Sequence
  probe sequence for 214718_at
tttttctcctgctacctagtaataa

SEQ ID NO: 1383 - DNA, 25 bp, Artificial Sequence
  probe sequence for 214718_at
tctcctgctacctagtaataaacaa

SEQ ID NO: 1384 - DNA, 25 bp, Artificial Sequence
  probe sequence for 214718_at
gtttattactggtcacttagaaaat

SEQ ID NO: 1385 - DNA, 25 bp, Artificial Sequence
  probe sequence for 214718_at
acctgaggtcgggaagtggatcgcc

SEQ ID NO: 1386 - DNA, 25 bp, Artificial Sequence
  probe sequence for 214718_at
aggtcgggaagtggatcgcctgagg

SEQ ID NO: 1387 - DNA, 25 bp, Artificial Sequence
  probe sequence for 207953_at
gtgtagtggtgcatgtctttggtcc

SEQ ID NO: 1388 - DNA, 25 bp, Artificial Sequence
  probe sequence for 207953_at
tgtagtggtgcatgtctttggtccc

SEQ ID NO: 1389 - DNA, 25 bp, Artificial Sequence
  probe sequence for 207953_at
acttcatcctgggtaagagtgggac

SEQ ID NO: 1390 - DNA, 25 bp, Artificial Sequence
  probe sequence for 207953_at
catcctgggtaagagtgggacacct

SEQ ID NO: 1391 - DNA, 25 bp, Artificial Sequence
  probe sequence for 207953_at
cctgggtaagagtgggacacctgtg

SEQ ID NO: 1392 - DNA, 25 bp, Artificial Sequence
  probe sequence for 207953_at
gagtgggacacctgtgtcttaaaaa

SEQ ID NO: 1393 - DNA, 25 bp, Artificial Sequence
  probe sequence for 207953_at
gaccagcttgggcacatcagtgaaa

SEQ ID NO: 1394 - DNA, 25 bp, Artificial Sequence
  probe sequence for 207953_at
cagcttgggcacatcagtgaaaccc

SEQ ID NO: 1395 - DNA, 25 bp, Artificial Sequence
  probe sequence for 207953_at
agcttgggcacatcagtgaaaccct

SEQ ID NO: 1396 - DNA, 25 bp, Artificial Sequence
  probe sequence for 207953_at
ttagccaggcagagccgggcatggt

SEQ ID NO: 1397 - DNA, 25 bp, Artificial Sequence
  probe sequence for 207953_at
ccagtcctgtatctagcactttggg

SEQ ID NO: 1398 - DNA, 25 bp, Artificial Sequence
  probe sequence for 201608_s_at
aatcaagggctgtctcgtgactgct

SEQ ID NO: 1399 - DNA, 25 bp, Artificial Sequence
  probe sequence for 201608_s_at
tctcgtgactgcttcagctgacaaa

SEQ ID NO: 1400 - DNA, 25 bp, Artificial Sequence
  probe sequence for 201608_s_at
tcatgttgccctgatttgccattta

SEQ ID NO: 1401 - DNA, 25 bp, Artificial Sequence
  probe sequence for 201608_s_at
agaagggcttcgggtctgggatata

SEQ ID NO: 1402 - DNA, 25 bp, Artificial Sequence
  probe sequence for 201608_s_at
gagagaggcttgttcttgggagtgc

SEQ ID NO: 1403 - DNA, 25 bp, Artificial Sequence
  probe sequence for 201608_s_at
tcatctattagtggcccttttggca

SEQ ID NO: 1404 - DNA, 25 bp, Artificial Sequence
  probe sequence for 201608_s_at
cagcaggagctcagatacacccatg

SEQ ID NO: 1405 - DNA, 25 bp, Artificial Sequence
  probe sequence for 201608_s_at
atctaatttcctgcttaccttaact

SEQ ID NO: 1406 - DNA, 25 bp, Artificial Sequence
  probe sequence for 201608_s_at
atgttccatgcgtggcagcaaccat

SEQ ID NO: 1407 - DNA, 25 bp, Artificial Sequence
  probe sequence for 201608_s_at
gtggcaccacaaatatccggtcttt

SEQ ID NO: 1408 - DNA, 25 bp, Artificial Sequence
  probe sequence for 201608_s_at
ttgtgcttgctcttcagatggatgg

SEQ ID NO: 1409 - DNA, 25 bp, Artificial Sequence
  probe sequence for 209015_s_at
gttgaactcatgtttcagttcgcga

SEQ ID NO: 1410 - DNA, 25 bp, Artificial Sequence
  probe sequence for 209015_s_at
cagttcgcgaacattgactccttac

SEQ ID NO: 1411 - DNA, 25 bp, Artificial Sequence
  probe sequence for 209015_s_at
gactccttacgaaagtcacttcatt

SEQ ID NO: 1412 - DNA, 25 bp, Artificial Sequence
  probe sequence for 209015_s_at
tcattctaactagatgcgcccactt

SEQ ID NO: 1413 - DNA, 25 bp, Artificial Sequence
  probe sequence for 209015_s_at
tttccttccctttcacatgaggatc

SEQ ID NO: 1414 - DNA, 25 bp, Artificial Sequence
  probe sequence for 209015_s_at
atgaggatctgccgttcatgttgct

SEQ ID NO: 1415 - DNA, 25 bp, Artificial Sequence
  probe sequence for 209015_s_at
gccagcaattttaatctagcagtgt

SEQ ID NO: 1416 - DNA, 25 bp, Artificial Sequence
  probe sequence for 209015_s_at
ggaattttttggcgcaatccatgta

SEQ ID NO: 1417 - DNA, 25 bp, Artificial Sequence
  probe sequence for 209015_s_at
gcaatccatgtagcagtgacccagg

SEQ ID NO: 1418 - DNA, 25 bp, Artificial Sequence
  probe sequence for 209015_s_at
tgacccaggcttgggagccagaaac

SEQ ID NO: 1419 - DNA, 25 bp, Artificial Sequence
  probe sequence for 209015_s_at
ttctgtggacaatgtaaccctaaac

SEQ ID NO: 1420 - DNA, 25 bp, Artificial Sequence
  probe sequence for 221759_at
cagcctagccttcaagtggtgtgag

SEQ ID NO: 1421 - DNA, 25 bp, Artificial Sequence
  probe sequence for 221759_at
ggtgtgagcggcctgagtggataca

SEQ ID NO: 1422 - DNA, 25 bp, Artificial Sequence
  probe sequence for 221759_at
agtggatacacgtggatagccggcc

SEQ ID NO: 1423 - DNA, 25 bp, Artificial Sequence
  probe sequence for 221759_at
tgcctccctgagccgtgactcaggg

SEQ ID NO: 1424 - DNA, 25 bp, Artificial Sequence
  probe sequence for 221759_at
ctatgcccaggtgcgtcgggcacag

SEQ ID NO: 1425 - DNA, 25 bp, Artificial Sequence
  probe sequence for 221759_at
agaagatagcctgccttgtgctggc

SEQ ID NO: 1426 - DNA, 25 bp, Artificial Sequence
  probe sequence for 221759_at
tcagcctcttctacattttcaattt

SEQ ID NO: 1427 - DNA, 25 bp, Artificial Sequence
  probe sequence for 221759_at
ctcgtgccctgggcagtgcacatgt

SEQ ID NO: 1428 - DNA, 25 bp, Artificial Sequence
  probe sequence for 221759_at
ggcagtgcacatgttcagtgcccag

SEQ ID NO: 1429 - DNA, 25 bp, Artificial Sequence
  probe sequence for 221759_at
cacaaagccaacactctgtgaccac

SEQ ID NO: 1430 - DNA, 25 bp, Artificial Sequence
  probe sequence for 221759_at
gccccaaagatgggccttctctctc

SEQ ID NO: 1431 - DNA, 25 bp, Artificial Sequence
  probe sequence for 205684_s_at
gaagtaactcttggggacaatatat

SEQ ID NO: 1432 - DNA, 25 bp, Artificial Sequence
  probe sequence for 205684_s_at
gcattaccttgaaatatgaagtgcc

SEQ ID NO: 1433 - DNA, 25 bp, Artificial Sequence
  probe sequence for 205684_s_at
agtgccatttgaatgtcccagggct

SEQ ID NO: 1434 - DNA, 25 bp, Artificial Sequence
  probe sequence for 205684_s_at
gccatttgaatgtcccagggcttat

SEQ ID NO: 1435 - DNA, 25 bp, Artificial Sequence
  probe sequence for 205684_s_at
ttgaatgtcccagggcttattaata

SEQ ID NO: 1436 - DNA, 25 bp, Artificial Sequence
  probe sequence for 205684_s_at
aagattttcaacccctgaactgctt

SEQ ID NO: 1437 - DNA, 25 bp, Artificial Sequence
  probe sequence for 205684_s_at
tctgcctctgtggaaaactactttg

SEQ ID NO: 1438 - DNA, 25 bp, Artificial Sequence
  probe sequence for 205684_s_at
gaaaactactttgggattcttcagt

SEQ ID NO: 1439 - DNA, 25 bp, Artificial Sequence
  probe sequence for 205684_s_at
tactttgggattcttcagtatttgt

SEQ ID NO: 1440 - DNA, 25 bp, Artificial Sequence
  probe sequence for 205684_s_at
attcattctaggcattgtttatatt

SEQ ID NO: 1441 - DNA, 25 bp, Artificial Sequence
  probe sequence for 205684_s_at
ctaggcattgtttatatttgaagtt

SEQ ID NO: 1442 - DNA, 25 bp, Artificial Sequence
  probe sequence for 209008_x_at
tgaaccggaacatcagccggctcca

SEQ ID NO: 1443 - DNA, 25 bp, Artificial Sequence
  probe sequence for 209008_x_at
gccggctccaggctgagattgaggg

SEQ ID NO: 1444 - DNA, 25 bp, Artificial Sequence
  probe sequence for 209008_x_at
gagcagcgtggagagctggccatta

SEQ ID NO: 1445 - DNA, 25 bp, Artificial Sequence
  probe sequence for 209008_x_at
aggatgccaacgccaagttgtccga

SEQ ID NO: 1446 - DNA, 25 bp, Artificial Sequence
  probe sequence for 209008_x_at
gggccaagcaggacatggcgcggca

SEQ ID NO: 1447 - DNA, 25 bp, Artificial Sequence
  probe sequence for 209008_x_at
cggcagctgcgtgagtaccaggagc

SEQ ID NO: 1448 - DNA, 25 bp, Artificial Sequence
  probe sequence for 209008_x_at
tcgccacctacaggaagctgctgga

SEQ ID NO: 1449 - DNA, 25 bp, Artificial Sequence
  probe sequence for 209008_x_at
gcggctatgcaggtggtctgagctc

SEQ ID NO: 1450 - DNA, 25 bp, Artificial Sequence
  probe sequence for 209008_x_at
tcctccagggccgtggttgtgaaga

SEQ ID NO: 1451 - DNA, 25 bp, Artificial Sequence
  probe sequence for 209008_x_at
tgggaagctggtgtctgagtcctct

SEQ ID NO: 1452 - DNA, 25 bp, Artificial Sequence
  probe sequence for 209008_x_at
gcccaagtgaacagctgcggcagcc

SEQ ID NO: 1453 - DNA, 25 bp, Artificial Sequence
  probe sequence for 200825_s_at
ctgggctgaccaaaatgtgctttct

SEQ ID NO: 1454 - DNA, 25 bp, Artificial Sequence
  probe sequence for 200825_s_at
aatgtgctttctactgtgagtccct

SEQ ID NO: 1455 - DNA, 25 bp, Artificial Sequence
  probe sequence for 200825_s_at
gtccctatcccaagatcctggggaa

SEQ ID NO: 1456 - DNA, 25 bp, Artificial Sequence
  probe sequence for 200825_s_at
tgaatgtagagatgccacctccctc

SEQ ID NO: 1457 - DNA, 25 bp, Artificial Sequence
  probe sequence for 200825_s_at
ctctctctgaggcaggcctgtggat

SEQ ID NO: 1458 - DNA, 25 bp, Artificial Sequence
  probe sequence for 200825_s_at
tctgtgcatcactctgctaggttgg

SEQ ID NO: 1459 - DNA, 25 bp, Artificial Sequence
  probe sequence for 200825_s_at
tcctccagtattccgtctgtagcag

SEQ ID NO: 1460 - DNA, 25 bp, Artificial Sequence
  probe sequence for 200825_s_at
gaatgaacctggctgtgtcagtcat

SEQ ID NO: 1461 - DNA, 25 bp, Artificial Sequence
  probe sequence for 200825_s_at
tgtgtcagtcattttgtcttttcct

SEQ ID NO: 1462 - DNA, 25 bp, Artificial Sequence
  probe sequence for 200825_s_at
agtagctgttgatgctggttggaca

SEQ ID NO: 1463 - DNA, 25 bp, Artificial Sequence
  probe sequence for 200825_s_at
gtactttgctccattgttaattgag

SEQ ID NO: 1464 - DNA, 25 bp, Artificial Sequence
  probe sequence for 218160_at
tgcggcccatcactatggagctcaa

SEQ ID NO: 1465 - DNA, 25 bp, Artificial Sequence
  probe sequence for 218160_at
caaggaatttatgctctgccgctgg

SEQ ID NO: 1466 - DNA, 25 bp, Artificial Sequence
  probe sequence for 218160_at
actggccagcagttatttcgtcact

SEQ ID NO: 1467 - DNA, 25 bp, Artificial Sequence
  probe sequence for 218160_at
cagatcgacctttaccggagaatcc

SEQ ID NO: 1468 - DNA, 25 bp, Artificial Sequence
  probe sequence for 218160_at
ggagaatccctatcactcaagacca

SEQ ID NO: 1469 - DNA, 25 bp, Artificial Sequence
  probe sequence for 218160_at
actcaagaccaagaccggatcccag

SEQ ID NO: 1470 - DNA, 25 bp, Artificial Sequence
  probe sequence for 218160_at
gatcgagggagatctgcagcctgcc

SEQ ID NO: 1471 - DNA, 25 bp, Artificial Sequence
  probe sequence for 218160_at
catggcagccgcttttatttctgga

SEQ ID NO: 1472 - DNA, 25 bp, Artificial Sequence
  probe sequence for 218160_at
taaagatgggtccgtggcccacact

SEQ ID NO: 1473 - DNA, 25 bp, Artificial Sequence
  probe sequence for 218160_at
acactcggtcatgtgctcagacaac

SEQ ID NO: 1474 - DNA, 25 bp, Artificial Sequence
  probe sequence for 218160_at
gaaaacgcccatgcggtttgcatcg

SEQ ID NO: 1475 - DNA, 25 bp, Artificial Sequence
  probe sequence for 220856_x_at
taaaagcacagacttcaggccaggc

SEQ ID NO: 1476 - DNA, 25 bp, Artificial Sequence
  probe sequence for 220856_x_at
ttcaggccaggcacaatgactcaca

SEQ ID NO: 1477 - DNA, 25 bp, Artificial Sequence
  probe sequence for 220856_x_at
gggctgattcagccccaggagttca

SEQ ID NO: 1478 - DNA, 25 bp, Artificial Sequence
  probe sequence for 220856_x_at
attagccggcagtggtggcacatgc

SEQ ID NO: 1479 - DNA, 25 bp, Artificial Sequence
  probe sequence for 220856_x_at
cagtcccagctactcgagaggatga

SEQ ID NO: 1480 - DNA, 25 bp, Artificial Sequence
  probe sequence for 220856_x_at
ccagctgggcatggtgactcacact

SEQ ID NO: 1481 - DNA, 25 bp, Artificial Sequence
  probe sequence for 220856_x_at
gccaaggagggcaggtcatgaggtc

SEQ ID NO: 1482 - DNA, 25 bp, Artificial Sequence
  probe sequence for 220856_x_at
ggccaatttgtacctgcaggcctcc

SEQ ID NO: 1483 - DNA, 25 bp, Artificial Sequence
  probe sequence for 220856_x_at
tcgaccgcgatgatgtggctctgga

SEQ ID NO: 1484 - DNA, 25 bp, Artificial Sequence
  probe sequence for 220856_x_at
tctggaaggcgtgagccacttcttc

SEQ ID NO: 1485 - DNA, 25 bp, Artificial Sequence
  probe sequence for 220856_x_at
cttcttccgcgaattggccgaggag

SEQ ID NO: 1486 - DNA, 25 bp, Artificial Sequence
  probe sequence for 57739_at
tcagcctccctgctgggacagggac

SEQ ID NO: 1487 - DNA, 25 bp, Artificial Sequence
  probe sequence for 57739_at
ccctgctgggacagggacctatggc

SEQ ID NO: 1488 - DNA, 25 bp, Artificial Sequence
  probe sequence for 57739_at
agcttagcatgaatcttctttattg

SEQ ID NO: 1489 - DNA, 25 bp, Artificial Sequence
  probe sequence for 57739_at
gcttagcatgaatcttctttattgt

SEQ ID NO: 1490 - DNA, 25 bp, Artificial Sequence
  probe sequence for 57739_at
agcatgaatcttctttattgtcctg

SEQ ID NO: 1491 - DNA, 25 bp, Artificial Sequence
  probe sequence for 57739_at
gcatgaatcttctttattgtcctga

SEQ ID NO: 1492 - DNA, 25 bp, Artificial Sequence
  probe sequence for 57739_at
gcagctgagccaaaggggtcagaaa

SEQ ID NO: 1493 - DNA, 25 bp, Artificial Sequence
  probe sequence for 57739_at
gggtcagaaattctgccctttgcct

SEQ ID NO: 1494 - DNA, 25 bp, Artificial Sequence
  probe sequence for 57739_at
ggtcagaaattctgccctttgcctc

SEQ ID NO: 1495 - DNA, 25 bp, Artificial Sequence
  probe sequence for 57739_at
ccaccacatggcattctggttttgg

SEQ ID NO: 1496 - DNA, 25 bp, Artificial Sequence
  probe sequence for 57739_at
caccacatggcattctggttttggt

SEQ ID NO: 1497 - DNA, 25 bp, Artificial Sequence
  probe sequence for 57739_at
accacatggcattctggttttggtt

SEQ ID NO: 1498 - DNA, 25 bp, Artificial Sequence
  probe sequence for 57739_at
ccacatggcattctggttttggttt

SEQ ID NO: 1499 - DNA, 25 bp, Artificial Sequence
  probe sequence for 57739_at
cacatggcattctggttttggtttc

SEQ ID NO: 1500 - DNA, 25 bp, Artificial Sequence
  probe sequence for 57739_at
acatggcattctggttttggtttct

SEQ ID NO: 1501 - DNA, 25 bp, Artificial Sequence
  probe sequence for 57739_at
catggcattctggttttggtttctg

SEQ ID NO: 1502 - DNA, 25 bp, Artificial Sequence
  probe sequence for 200654_at
atcagggtatttgttccaccttggc

SEQ ID NO: 1503 - DNA, 25 bp, Artificial Sequence
  probe sequence for 200654_at
ccggactggacatggtcactcagta

SEQ ID NO: 1504 - DNA, 25 bp, Artificial Sequence
  probe sequence for 200654_at
actggacatggtcactcagtaccgc

SEQ ID NO: 1505 - DNA, 25 bp, Artificial Sequence
  probe sequence for 200654_at
cctgcagtgtcgccatgactgatca

SEQ ID NO: 1506 - DNA, 25 bp, Artificial Sequence
  probe sequence for 200654_at
atgactgatcatggctcttgcattt

SEQ ID NO: 1507 - DNA, 25 bp, Artificial Sequence
  probe sequence for 200654_at
catggctcttgcatttttgggtaaa

SEQ ID NO: 1508 - DNA, 25 bp, Artificial Sequence
  probe sequence for 200654_at
gacttccggatcctgtcagggtgtc

SEQ ID NO: 1509 - DNA, 25 bp, Artificial Sequence
  probe sequence for 200654_at
aggctcaggccaggtctggacagct

SEQ ID NO: 1510 - DNA, 25 bp, Artificial Sequence
  probe sequence for 200654_at
aggccaggtctggacagctgtgact

SEQ ID NO: 1511 - DNA, 25 bp, Artificial Sequence
  probe sequence for 200654_at
accagccggctatgggcacattacg

SEQ ID NO: 1512 - DNA, 25 bp, Artificial Sequence
  probe sequence for 200654_at
tgggcacattacgtgaccactggcc

SEQ ID NO: 1513 - DNA, 25 bp, Artificial Sequence
  probe sequence for 220071_x_at
tagccgaccatggtggtgcatgcct

SEQ ID NO: 1514 - DNA, 25 bp, Artificial Sequence
  probe sequence for 220071_x_at
ggtaagaggatcacctaagcctgtg

SEQ ID NO: 1515 - DNA, 25 bp, Artificial Sequence
  probe sequence for 220071_x_at
aagcctgtgaggtcatggttgcaat

SEQ ID NO: 1516 - DNA, 25 bp, Artificial Sequence
  probe sequence for 220071_x_at
caatgagtcatgatcacgccactgc

SEQ ID NO: 1517 - DNA, 25 bp, Artificial Sequence
  probe sequence for 220071_x_at
gcgacacagtaagaccctgtctcaa

SEQ ID NO: 1518 - DNA, 25 bp, Artificial Sequence
  probe sequence for 220071_x_at
aagaagtgtgtttctggccaggcac

SEQ ID NO: 1519 - DNA, 25 bp, Artificial Sequence
  probe sequence for 220071_x_at
ggaggcctaggtgggcagatcatga

SEQ ID NO: 1520 - DNA, 25 bp, Artificial Sequence
  probe sequence for 220071_x_at
gccaacatggcgaaacacctgtctc

SEQ ID NO: 1521 - DNA, 25 bp, Artificial Sequence
  probe sequence for 220071_x_at
actttgggaggccgacccagatggg

SEQ ID NO: 1522 - DNA, 25 bp, Artificial Sequence
  probe sequence for 220071_x_at
aggccgacccagatgggtggatcac

SEQ ID NO: 1523 - DNA, 25 bp, Artificial Sequence
  probe sequence for 220071_x_at
cagtaagccaagatcgtgcctctgc

SEQ ID NO: 1524 - DNA, 25 bp, Artificial Sequence
  probe sequence for 216745_x_at
tgtggtggcatgtgcctatagttcc

SEQ ID NO: 1525 - DNA, 25 bp, Artificial Sequence
  probe sequence for 216745_x_at
ggattagttgagcccagaagttcga

SEQ ID NO: 1526 - DNA, 25 bp, Artificial Sequence
  probe sequence for 216745_x_at
tgacatagtgagaccctgccttaaa

SEQ ID NO: 1527 - DNA, 25 bp, Artificial Sequence
  probe sequence for 216745_x_at
agagggtaagcatcatgacatctcc

SEQ ID NO: 1528 - DNA, 25 bp, Artificial Sequence
  probe sequence for 216745_x_at
atctccttaccctgattaatctcaa

SEQ ID NO: 1529 - DNA, 25 bp, Artificial Sequence
  probe sequence for 216745_x_at
accctgattaatctcaaactgttca

SEQ ID NO: 1530 - DNA, 25 bp, Artificial Sequence
  probe sequence for 216745_x_at
atatatacacacatccgcatacctt

SEQ ID NO: 1531 - DNA, 25 bp, Artificial Sequence
  probe sequence for 216745_x_at
cgcataccttcgcatacacatatac

SEQ ID NO: 1532 - DNA, 25 bp, Artificial Sequence
  probe sequence for 216745_x_at
agcaaatgcaggctgggcacggttg

SEQ ID NO: 1533 - DNA, 25 bp, Artificial Sequence
  probe sequence for 216745_x_at
ttagctggatgtagtggcgggcgcc

SEQ ID NO: 1534 - DNA, 25 bp, Artificial Sequence
  probe sequence for 216745_x_at
gttgcagtgaacggagatggcgcca

SEQ ID NO: 1535 - DNA, 25 bp, Artificial Sequence
  probe sequence for 218976_at
cccaagcccctagagaagtcagtct

SEQ ID NO: 1536 - DNA, 25 bp, Artificial Sequence
  probe sequence for 218976_at
agtctccccgcaaaattcagattct

SEQ ID NO: 1537 - DNA, 25 bp, Artificial Sequence
  probe sequence for 218976_at
tgtgaatggttggcaccttcgtttc

SEQ ID NO: 1538 - DNA, 25 bp, Artificial Sequence
  probe sequence for 218976_at
ctatgctgccaacatgcagtctttg

SEQ ID NO: 1539 - DNA, 25 bp, Artificial Sequence
  probe sequence for 218976_at
catgtctgtgaattgctgagtacta

SEQ ID NO: 1540 - DNA, 25 bp, Artificial Sequence
  probe sequence for 218976_at
tactaattgattcctccatccttga

SEQ ID NO: 1541 - DNA, 25 bp, Artificial Sequence
  probe sequence for 218976_at
gaatcagttctcataatgcttttta

SEQ ID NO: 1542 - DNA, 25 bp, Artificial Sequence
  probe sequence for 218976_at
atgctttttcctattaatactactt

SEQ ID NO: 1543 - DNA, 25 bp, Artificial Sequence
  probe sequence for 218976_at
attgacatactgtgatctctattag

SEQ ID NO: 1544 - DNA, 25 bp, Artificial Sequence
  probe sequence for 218976_at
tgttttcttacccttgacttacaat

SEQ ID NO: 1545 - DNA, 25 bp, Artificial Sequence
  probe sequence for 218976_at
gtgaaattacttgtctgaaccccgt

SEQ ID NO: 1546 - DNA, 25 bp, Artificial Sequence
  probe sequence for 211921_x_at
atgtcagacgcagccgtagacacca

SEQ ID NO: 1547 - DNA, 25 bp, Artificial Sequence
  probe sequence for 211921_x_at
agctccgaaatcaccaccaaggact

SEQ ID NO: 1548 - DNA, 25 bp, Artificial Sequence
  probe sequence for 211921_x_at
gaaaatggaagagacgcccctgcta

SEQ ID NO: 1549 - DNA, 25 bp, Artificial Sequence
  probe sequence for 211921_x_at
acgcccctgctaacgggaatgctaa

SEQ ID NO: 1550 - DNA, 25 bp, Artificial Sequence
  probe sequence for 211921_x_at
gcaggaggctgacaatgaggtagac

SEQ ID NO: 1551 - DNA, 25 bp, Artificial Sequence
  probe sequence for 211921_x_at
aagctgagtcagctacgggcaagcg

SEQ ID NO: 1552 - DNA, 25 bp, Artificial Sequence
  probe sequence for 211921_x_at
ctacgggcaagcgggcagctgaaga

SEQ ID NO: 1553 - DNA, 25 bp, Artificial Sequence
  probe sequence for 211921_x_at
agcgggcagctgaagatgatgagga

SEQ ID NO: 1554 - DNA, 25 bp, Artificial Sequence
  probe sequence for 211921_x_at
gaggatgacgatgtcgataccaaga

SEQ ID NO: 1555 - DNA, 25 bp, Artificial Sequence
  probe sequence for 211921_x_at
gataccaagaagcagaagaccgacg

SEQ ID NO: 1556 - DNA, 25 bp, Artificial Sequence
  probe sequence for 211921_x_at
gcagaagaccgacgaggatgactag

SEQ ID NO: 1557 - DNA, 25 bp, Artificial Sequence
  probe sequence for 218074_at
cagcatcgacgcacgcgagatcttc

SEQ ID NO: 1558 - DNA, 25 bp, Artificial Sequence
  probe sequence for 218074_at
cgatctgattcgctccatcaatgac

SEQ ID NO: 1559 - DNA, 25 bp, Artificial Sequence
  probe sequence for 218074_at
gagcatccactgacgctagaggagt

SEQ ID NO: 1560 - DNA, 25 bp, Artificial Sequence
  probe sequence for 218074_at
gcaggtgcgggttcaggttagcgac

SEQ ID NO: 1561 - DNA, 25 bp, Artificial Sequence
  probe sequence for 218074_at
agtacagtggctgtggctttcacac

SEQ ID NO: 1562 - DNA, 25 bp, Artificial Sequence
  probe sequence for 218074_at
gtccatcaaggtcaagcttctgcgc

SEQ ID NO: 1563 - DNA, 25 bp, Artificial Sequence
  probe sequence for 218074_at
aagatggacgtgcacattactccgg

SEQ ID NO: 1564 - DNA, 25 bp, Artificial Sequence
  probe sequence for 218074_at
ataaggagcgggtggcagctgccct

SEQ ID NO: 1565 - DNA, 25 bp, Artificial Sequence
  probe sequence for 218074_at
gaacacccacctcttggaggttgtg

SEQ ID NO: 1566 - DNA, 25 bp, Artificial Sequence
  probe sequence for 218074_at
ctcagcctgcatactggtatcctgg

SEQ ID NO: 1567 - DNA, 25 bp, Artificial Sequence
  probe sequence for 218074_at
gctgttaccgttgttttcttgaatc

SEQ ID NO: 1568 - DNA, 25 bp, Artificial Sequence
  probe sequence for 200914_x_at
ttcccggccgcacagggttttatag

SEQ ID NO: 1569 - DNA, 25 bp, Artificial Sequence
  probe sequence for 200914_x_at
gcacagggttttataggatcacatt

SEQ ID NO: 1570 - DNA, 25 bp, Artificial Sequence
  probe sequence for 200914_x_at
ggatcacattgacaaaagtaccatg

SEQ ID NO: 1571 - DNA, 25 bp, Artificial Sequence
  probe sequence for 200914_x_at
gtaccatggagttttatgagtcagc

SEQ ID NO: 1572 - DNA, 25 bp, Artificial Sequence
  probe sequence for 200914_x_at
gagtcagcatattttattgttctta

SEQ ID NO: 1573 - DNA, 25 bp, Artificial Sequence
  probe sequence for 200914_x_at
atattttattgttcttattccttca

SEQ ID NO: 1574 - DNA, 25 bp, Artificial Sequence
  probe sequence for 200914_x_at
gttcttattccttcaatagttatta

SEQ ID NO: 1575 - DNA, 25 bp, Artificial Sequence
  probe sequence for 200914_x_at
attacagtaattttcctcttcttct

SEQ ID NO: 1576 - DNA, 25 bp, Artificial Sequence
  probe sequence for 200914_x_at
cctcttcttctggcttttcatgaaa

SEQ ID NO: 1577 - DNA, 25 bp, Artificial Sequence
  probe sequence for 200914_x_at
gagaacaaaagcttattcctaccaa

SEQ ID NO: 1578 - DNA, 25 bp, Artificial Sequence
  probe sequence for 200914_x_at
aaagcttattcctaccaaaacagat

SEQ ID NO: 1579 - DNA, 25 bp, Artificial Sequence
  probe sequence for 214833_at
gaatgagcttgaagtgctcccctct

SEQ ID NO: 1580 - DNA, 25 bp, Artificial Sequence
  probe sequence for 214833_at
cctctgacagttttgctctttggtt

SEQ ID NO: 1581 - DNA, 25 bp, Artificial Sequence
  probe sequence for 214833_at
tgacagttttgctctttggttcaca

SEQ ID NO: 1582 - DNA, 25 bp, Artificial Sequence
  probe sequence for 214833_at
tctttggttcacaaggcttcctaaa

SEQ ID NO: 1583 - DNA, 25 bp, Artificial Sequence
  probe sequence for 214833_at
tggttcacaaggcttcctaaactca

SEQ ID NO: 1584 - DNA, 25 bp, Artificial Sequence
  probe sequence for 214833_at
gttcacaaggcttcctaaactcagg

SEQ ID NO: 1585 - DNA, 25 bp, Artificial Sequence
  probe sequence for 214833_at
aaggcttcctaaactcaggattgct

SEQ ID NO: 1586 - DNA, 25 bp, Artificial Sequence
  probe sequence for 214833_at
aaactcaggattgctttgtgggtct

SEQ ID NO: 1587 - DNA, 25 bp, Artificial Sequence
  probe sequence for 214833_at
caggattgctttgtgggtctgttct

SEQ ID NO: 1588 - DNA, 25 bp, Artificial Sequence
  probe sequence for 214833_at
aggccagggcaggtgcaagctatgc

SEQ ID NO: 1589 - DNA, 25 bp, Artificial Sequence
  probe sequence for 214833_at
ggccagggcaggtgcaagctatgcc

SEQ ID NO: 1590 - DNA, 25 bp, Artificial Sequence
  probe sequence for 216384_x_at
atgtcagacgcagccgtagacacca

SEQ ID NO: 1591 - DNA, 25 bp, Artificial Sequence
  probe sequence for 216384_x_at
ctccgaaatcaccaccgaggactta

SEQ ID NO: 1592 - DNA, 25 bp, Artificial Sequence
  probe sequence for 216384_x_at
gaaggaagttgtggaagaggcggaa

SEQ ID NO: 1593 - DNA, 25 bp, Artificial Sequence
  probe sequence for 216384_x_at
gaaaatggaagagacgcccctgctc

SEQ ID NO: 1594 - DNA, 25 bp, Artificial Sequence
  probe sequence for 216384_x_at
gcccctgctcacgggaatgctaatg

SEQ ID NO: 1595 - DNA, 25 bp, Artificial Sequence
  probe sequence for 216384_x_at
gaggaaaatggggagccggaggctg

SEQ ID NO: 1596 - DNA, 25 bp, Artificial Sequence
  probe sequence for 216384_x_at
gagccggaggctgacaacgaggtag

SEQ ID NO: 1597 - DNA, 25 bp, Artificial Sequence
  probe sequence for 216384_x_at
ggtggggaggaagaaggtgatggtg

SEQ ID NO: 1598 - DNA, 25 bp, Artificial Sequence
  probe sequence for 216384_x_at
gagctgagtcagctacgggcaagcg

SEQ ID NO: 1599 - DNA, 25 bp, Artificial Sequence
  probe sequence for 216384_x_at
acgggcaagcgggcagctgaagatg

SEQ ID NO: 1600 - DNA, 25 bp, Artificial Sequence
  probe sequence for 216384_x_at
agatgatgaggatgacgatgtcgat

SEQ ID NO: 1601 - DNA, 25 bp, Artificial Sequence
  probe sequence for 214594_x_at
tcctattattcggccgggcgtggtg

SEQ ID NO: 1602 - DNA, 25 bp, Artificial Sequence
  probe sequence for 214594_x_at
cctattattcggccgggcgtggtgg

SEQ ID NO: 1603 - DNA, 25 bp, Artificial Sequence
  probe sequence for 214594_x_at
atttaaaaataggccgggcatggtg

SEQ ID NO: 1604 - DNA, 25 bp, Artificial Sequence
  probe sequence for 214594_x_at
tttaaaaataggccgggcatggtgg

SEQ ID NO: 1605 - DNA, 25 bp, Artificial Sequence
  probe sequence for 214594_x_at
acaaaaattagctggaaatcgcttg

SEQ ID NO: 1606 - DNA, 25 bp, Artificial Sequence
  probe sequence for 214594_x_at
aaaaattagctggaaatcgcttgaa

SEQ ID NO: 1607 - DNA, 25 bp, Artificial Sequence
  probe sequence for 214594_x_at
aaaattagctggaaatcgcttgaac

SEQ ID NO: 1608 - DNA, 25 bp, Artificial Sequence
  probe sequence for 214594_x_at
aaattagctggaaatcgcttgaacc

SEQ ID NO: 1609 - DNA, 25 bp, Artificial Sequence
  probe sequence for 214594_x_at
aattagctggaaatcgcttgaacct

SEQ ID NO: 1610 - DNA, 25 bp, Artificial Sequence
  probe sequence for 214594_x_at
attagctggaaatcgcttgaacctg

SEQ ID NO: 1611 - DNA, 25 bp, Artificial Sequence
  probe sequence for 214594_x_at
tgagccgagatcgtggcactgcagc

SEQ ID NO: 1612 - DNA, 25 bp, Artificial Sequence
  probe sequence for 222122_s_at
tacaaactaaccaaggcatcggtac

SEQ ID NO: 1613 - DNA, 25 bp, Artificial Sequence
  probe sequence for 222122_s_at
gcatcggtacattgccttgaaacag

SEQ ID NO: 1614 - DNA, 25 bp, Artificial Sequence
  probe sequence for 222122_s_at
aacaggcgaatatactcacatcagg

SEQ ID NO: 1615 - DNA, 25 bp, Artificial Sequence
  probe sequence for 222122_s_at
gagaagaggccagatctatatgcat

SEQ ID NO: 1616 - DNA, 25 bp, Artificial Sequence
  probe sequence for 222122_s_at
gggctactctgggcagttgaaaagt

SEQ ID NO: 1617 - DNA, 25 bp, Artificial Sequence
  probe sequence for 222122_s_at
aatgagtttcatcacaaagaccccc

SEQ ID NO: 1618 - DNA, 25 bp, Artificial Sequence
  probe sequence for 222122_s_at
cccctccgaggaatgcagttgccag

SEQ ID NO: 1619 - DNA, 25 bp, Artificial Sequence
  probe sequence for 222122_s_at
gtgtgcaaaatgggcctggtggtgg

SEQ ID NO: 1620 - DNA, 25 bp, Artificial Sequence
  probe sequence for 222122_s_at
gggagagatctcagtgtggtgtgaa

SEQ ID NO: 1621 - DNA, 25 bp, Artificial Sequence
  probe sequence for 222122_s_at
aaagcttctagtaccacacctaaag

SEQ ID NO: 1622 - DNA, 25 bp, Artificial Sequence
  probe sequence for 222122_s_at
ggaaatagtggctctaacagcaaca

SEQ ID NO: 1623 - DNA, 25 bp, Artificial Sequence
  probe sequence for 202004_x_at
atgaggtggctgcaaaaactcccct

SEQ ID NO: 1624 - DNA, 25 bp, Artificial Sequence
  probe sequence for 202004_x_at
cctactctcggcctagaagcagtta

SEQ ID NO: 1625 - DNA, 25 bp, Artificial Sequence
  probe sequence for 202004_x_at
gttattctctctccatattgggctt

SEQ ID NO: 1626 - DNA, 25 bp, Artificial Sequence
  probe sequence for 202004_x_at
tgctgagggtcagcttttggctcct

SEQ ID NO: 1627 - DNA, 25 bp, Artificial Sequence
  probe sequence for 202004_x_at
gctccttcttcctgagacagtggaa

SEQ ID NO: 1628 - DNA, 25 bp, Artificial Sequence
  probe sequence for 202004_x_at
aacaatgccagctctgtggcttctg

SEQ ID NO: 1629 - DNA, 25 bp, Artificial Sequence
  probe sequence for 202004_x_at
gttgggtgaagctttgggttgccac

SEQ ID NO: 1630 - DNA, 25 bp, Artificial Sequence
  probe sequence for 202004_x_at
ctgcctgtgggtttgctggcttaaa

SEQ ID NO: 1631 - DNA, 25 bp, Artificial Sequence
  probe sequence for 202004_x_at
cccaggccattaacaactaacacag

SEQ ID NO: 1632 - DNA, 25 bp, Artificial Sequence
  probe sequence for 202004_x_at
ggaattagtctgtcccagctagagg

SEQ ID NO: 1633 - DNA, 25 bp, Artificial Sequence
  probe sequence for 202004_x_at
agttagttcttggagcagctgcttt

SEQ ID NO: 1634 - DNA, 25 bp, Artificial Sequence
  probe sequence for 204060_s_at
gtgtgttgggaagttctgttgaggc

SEQ ID NO: 1635 - DNA, 25 bp, Artificial Sequence
  probe sequence for 204060_s_at
gggaagttctgttgaggcttagttt

SEQ ID NO: 1636 - DNA, 25 bp, Artificial Sequence
  probe sequence for 204060_s_at
gttgaggcttagtttgatcttccat

SEQ ID NO: 1637 - DNA, 25 bp, Artificial Sequence
  probe sequence for 204060_s_at
cttagtttgatcttccatggtggac

SEQ ID NO: 1638 - DNA, 25 bp, Artificial Sequence
  probe sequence for 204060_s_at
tttccacagtccttgtgctctgaga

SEQ ID NO: 1639 - DNA, 25 bp, Artificial Sequence
  probe sequence for 204060_s_at
cacagtccttgtgctctgagatggc

SEQ ID NO: 1640 - DNA, 25 bp, Artificial Sequence
  probe sequence for 204060_s_at
gtccttgtgctctgagatggctgtt

SEQ ID NO: 1641 - DNA, 25 bp, Artificial Sequence
  probe sequence for 204060_s_at
tgagatggctgttgagctctgctca

SEQ ID NO: 1642 - DNA, 25 bp, Artificial Sequence
  probe sequence for 204060_s_at
cacacaggcagagtgccttggcagg

SEQ ID NO: 1643 - DNA, 25 bp, Artificial Sequence
  probe sequence for 204060_s_at
accccttggcgagccagaactggga

SEQ ID NO: 1644 - DNA, 25 bp, Artificial Sequence
  probe sequence for 204060_s_at
tttgtacatatgccctaggaaaatt

SEQ ID NO: 1645 - DNA, 25 bp, Artificial Sequence
  probe sequence for 209653_at
gtaattgatgccaatcttgtaccaa

SEQ ID NO: 1646 - DNA, 25 bp, Artificial Sequence
  probe sequence for 209653_at
ggataagggggattttggcactcaa

SEQ ID NO: 1647 - DNA, 25 bp, Artificial Sequence
  probe sequence for 209653_at
gaagctgcttgggccataagtaact

SEQ ID NO: 1648 - DNA, 25 bp, Artificial Sequence
  probe sequence for 209653_at
gatcaagtggcttaccttatccaac

SEQ ID NO: 1649 - DNA, 25 bp, Artificial Sequence
  probe sequence for 209653_at
tcccacctttttgcaacttgctgac

SEQ ID NO: 1650 - DNA, 25 bp, Artificial Sequence
  probe sequence for 209653_at
gacatctacaaattggcctatgaga

SEQ ID NO: 1651 - DNA, 25 bp, Artificial Sequence
  probe sequence for 209653_at
gatcattgatcagttcttctcttca

SEQ ID NO: 1652 - DNA, 25 bp, Artificial Sequence
  probe sequence for 209653_at
gatattgatgaagaccctagccttg

SEQ ID NO: 1653 - DNA, 25 bp, Artificial Sequence
  probe sequence for 209653_at
ccctagccttgttccagaggcaatt

SEQ ID NO: 1654 - DNA, 25 bp, Artificial Sequence
  probe sequence for 209653_at
ggcggaacatttggtttcaattcat

SEQ ID NO: 1655 - DNA, 25 bp, Artificial Sequence
  probe sequence for 209653_at
tcaattcatctgccaatgtaccaac

SEQ ID NO: 1656 - DNA, 25 bp, Artificial Sequence
  probe sequence for 210858_x_at
tgctcatacagcaggccatagaccc

SEQ ID NO: 1657 - DNA, 25 bp, Artificial Sequence
  probe sequence for 210858_x_at
catagaccccaaaaatctcagccga

SEQ ID NO: 1658 - DNA, 25 bp, Artificial Sequence
  probe sequence for 210858_x_at
tcagccgacttttcccaggatggaa

SEQ ID NO: 1659 - DNA, 25 bp, Artificial Sequence
  probe sequence for 210858_x_at
ggaaagcttgggtgtgatcttcagt

SEQ ID NO: 1660 - DNA, 25 bp, Artificial Sequence
  probe sequence for 210858_x_at
ttaccctttcattcagcctttagaa

SEQ ID NO: 1661 - DNA, 25 bp, Artificial Sequence
  probe sequence for 210858_x_at
gcctttatttttaacctgccaacat

SEQ ID NO: 1662 - DNA, 25 bp, Artificial Sequence
  probe sequence for 210858_x_at
taaggaacatctctgctttcactct

SEQ ID NO: 1663 - DNA, 25 bp, Artificial Sequence
  probe sequence for 210858_x_at
aaataatggtcattcgggctgggcg

SEQ ID NO: 1664 - DNA, 25 bp, Artificial Sequence
  probe sequence for 210858_x_at
ttagccgagcatggtggcgggcacc

SEQ ID NO: 1665 - DNA, 25 bp, Artificial Sequence
  probe sequence for 210858_x_at
gggaggtgaaggttgctgtgggcca

SEQ ID NO: 1666 - DNA, 25 bp, Artificial Sequence
  probe sequence for 210858_x_at
gtgggccaaaatcatgccattgcac

SEQ ID NO: 1667 - DNA, 25 bp, Artificial Sequence
  probe sequence for 215314_at
ctcagcctcctaaggagctattttt

SEQ ID NO: 1668 - DNA, 25 bp, Artificial Sequence
  probe sequence for 215314_at
gtgcccagctagattctttactttt

SEQ ID NO: 1669 - DNA, 25 bp, Artificial Sequence
  probe sequence for 215314_at
tatgcctctttctgtagatcaaatg

SEQ ID NO: 1670 - DNA, 25 bp, Artificial Sequence
  probe sequence for 215314_at
gaaatatggcccaatttacaagggt

SEQ ID NO: 1671 - DNA, 25 bp, Artificial Sequence
  probe sequence for 215314_at
gggtatacaccttcatggtagatga

SEQ ID NO: 1672 - DNA, 25 bp, Artificial Sequence
  probe sequence for 215314_at
gatttaattgtagtttctgctgcca

SEQ ID NO: 1673 - DNA, 25 bp, Artificial Sequence
  probe sequence for 215314_at
gccaaaaagtctccataattatttt

SEQ ID NO: 1674 - DNA, 25 bp, Artificial Sequence
  probe sequence for 215314_at
aataacttataactaccttgatctt

SEQ ID NO: 1675 - DNA, 25 bp, Artificial Sequence
  probe sequence for 215314_at
taactaccttgatctttacctgtac

SEQ ID NO: 1676 - DNA, 25 bp, Artificial Sequence
  probe sequence for 215314_at
ccttgatctttacctgtacacacac

SEQ ID NO: 1677 - DNA, 25 bp, Artificial Sequence
  probe sequence for 215314_at
gtaatttcacttagaatcctggtca

SEQ ID NO: 1678 - DNA, 25 bp, Artificial Sequence
  probe sequence for 208238_x_at
gagttgtcagaaaggtttccctgca

SEQ ID NO: 1679 - DNA, 25 bp, Artificial Sequence
  probe sequence for 208238_x_at
gaaaggtttccctgcagataaactt

SEQ ID NO: 1680 - DNA, 25 bp, Artificial Sequence
  probe sequence for 208238_x_at
aaagatctcaacctgtggacgggaa

SEQ ID NO: 1681 - DNA, 25 bp, Artificial Sequence
  probe sequence for 208238_x_at
agagtccccactggcacagtggctc

SEQ ID NO: 1682 - DNA, 25 bp, Artificial Sequence
  probe sequence for 208238_x_at
agcacttctagaggctgaggcgggt

SEQ ID NO: 1683 - DNA, 25 bp, Artificial Sequence
  probe sequence for 208238_x_at
aggcgggtgtattgcttgagcccag

SEQ ID NO: 1684 - DNA, 25 bp, Artificial Sequence
  probe sequence for 208238_x_at
gagcccagaagtttgagagcagcct

SEQ ID NO: 1685 - DNA, 25 bp, Artificial Sequence
  probe sequence for 208238_x_at
catgagggtacacacctgtagtccc

SEQ ID NO: 1686 - DNA, 25 bp, Artificial Sequence
  probe sequence for 208238_x_at
gctgcagtgagcctaggtggtgcca

SEQ ID NO: 1687 - DNA, 25 bp, Artificial Sequence
  probe sequence for 208238_x_at
gcactccaacctgggggacagagga

SEQ ID NO: 1688 - DNA, 25 bp, Artificial Sequence
  probe sequence for 208238_x_at
gggacagaggaggccctgtcccgag

SEQ ID NO: 1689 - DNA, 25 bp, Artificial Sequence
  probe sequence for 212041_at
gtgtcgcaacatcgtgtggatcgct

SEQ ID NO: 1690 - DNA, 25 bp, Artificial Sequence
  probe sequence for 212041_at
gtggatcgctgaatgtatcgcccag

SEQ ID NO: 1691 - DNA, 25 bp, Artificial Sequence
  probe sequence for 212041_at
caccgcgccaaaatcgacaactaca

SEQ ID NO: 1692 - DNA, 25 bp, Artificial Sequence
  probe sequence for 212041_at
aaatcgacaactacatccctatctt

SEQ ID NO: 1693 - DNA, 25 bp, Artificial Sequence
  probe sequence for 212041_at
ggctctcaattgcactctttgtgtg

SEQ ID NO: 1694 - DNA, 25 bp, Artificial Sequence
  probe sequence for 212041_at
gtgtatgtggtctgtgacaagcctg

SEQ ID NO: 1695 - DNA, 25 bp, Artificial Sequence
  probe sequence for 212041_at
ctgtgacaagcctgtggctcacctg

SEQ ID NO: 1696 - DNA, 25 bp, Artificial Sequence
  probe sequence for 212041_at
caccaaggatggacgaagaccccct

SEQ ID NO: 1697 - DNA, 25 bp, Artificial Sequence
  probe sequence for 212041_at
tcagccctgtggttacagccgctga

SEQ ID NO: 1698 - DNA, 25 bp, Artificial Sequence
  probe sequence for 212041_at
acagccgctgatgtatctaagaagc

SEQ ID NO: 1699 - DNA, 25 bp, Artificial Sequence
  probe sequence for 212041_at
ccctgcccctctgagacaataaaac

SEQ ID NO: 1700 - DNA, 25 bp, Artificial Sequence
  probe sequence for 221294_at
tcctgatttggctatactcgaccct

SEQ ID NO: 1701 - DNA, 25 bp, Artificial Sequence
  probe sequence for 221294_at
ttcagtggtgtgcggagtcctggca

SEQ ID NO: 1702 - DNA, 25 bp, Artificial Sequence
  probe sequence for 221294_at
ctacttcaccctgttcatcgtgatg

SEQ ID NO: 1703 - DNA, 25 bp, Artificial Sequence
  probe sequence for 221294_at
tgatgatgttatatgccccagcagc

SEQ ID NO: 1704 - DNA, 25 bp, Artificial Sequence
  probe sequence for 221294_at
ggcctgtcctgataagcgctatgcc

SEQ ID NO: 1705 - DNA, 25 bp, Artificial Sequence
  probe sequence for 221294_at
ctatgccatggtcctgtttcgaatc

SEQ ID NO: 1706 - DNA, 25 bp, Artificial Sequence
  probe sequence for 221294_at
gtattttacatcctctggttgccat

SEQ ID NO: 1707 - DNA, 25 bp, Artificial Sequence
  probe sequence for 221294_at
ggttgccatatatcatctacttctt

SEQ ID NO: 1708 - DNA, 25 bp, Artificial Sequence
  probe sequence for 221294_at
gactaaagcgcctctcaggggctat

SEQ ID NO: 1709 - DNA, 25 bp, Artificial Sequence
  probe sequence for 221294_at
caggggctatgtgtacttcttgtgc

SEQ ID NO: 1710 - DNA, 25 bp, Artificial Sequence
  probe sequence for 221294_at
gccaacgacccttacacagttagaa

SEQ ID NO: 1711 - DNA, 25 bp, Artificial Sequence
  probe sequence for 210705_s_at
catgttggttaggctcgtctagaac

SEQ ID NO: 1712 - DNA, 25 bp, Artificial Sequence
  probe sequence for 210705_s_at
gttaggctcgtctagaacctctgac

SEQ ID NO: 1713 - DNA, 25 bp, Artificial Sequence
  probe sequence for 210705_s_at
ataagtgctaatgttttattgcata

SEQ ID NO: 1714 - DNA, 25 bp, Artificial Sequence
  probe sequence for 210705_s_at
attgcatagtagggtgactagagtt

SEQ ID NO: 1715 - DNA, 25 bp, Artificial Sequence
  probe sequence for 210705_s_at
gagttaacaataacctattgcatat

SEQ ID NO: 1716 - DNA, 25 bp, Artificial Sequence
  probe sequence for 210705_s_at
gaaatgacacatatttgaggtgatg

SEQ ID NO: 1717 - DNA, 25 bp, Artificial Sequence
  probe sequence for 210705_s_at
atgctaattaccctggttcggttat

SEQ ID NO: 1718 - DNA, 25 bp, Artificial Sequence
  probe sequence for 210705_s_at
taccctggttcggttattacgcaat

SEQ ID NO: 1719 - DNA, 25 bp, Artificial Sequence
  probe sequence for 210705_s_at
ggttcggttattacgcaatgtatac

SEQ ID NO: 1720 - DNA, 25 bp, Artificial Sequence
  probe sequence for 210705_s_at
aaaaccttcatctaatactttggat

SEQ ID NO: 1721 - DNA, 25 bp, Artificial Sequence
  probe sequence for 210705_s_at
catctaatactttggatcattgtga

SEQ ID NO: 1722 - DNA, 25 bp, Artificial Sequence
  probe sequence for 211184_s_at
gtctgccccccaaaggagtatgacg

SEQ ID NO: 1723 - DNA, 25 bp, Artificial Sequence
  probe sequence for 211184_s_at
gagtatgacgatgagctgaccttct

SEQ ID NO: 1724 - DNA, 25 bp, Artificial Sequence
  probe sequence for 211184_s_at
acacacaccagatggcatccttggg

SEQ ID NO: 1725 - DNA, 25 bp, Artificial Sequence
  probe sequence for 211184_s_at
atccttgggacctgaatctatcacc

SEQ ID NO: 1726 - DNA, 25 bp, Artificial Sequence
  probe sequence for 211184_s_at
cacccaggaatctcaaactcccttt

SEQ ID NO: 1727 - DNA, 25 bp, Artificial Sequence
  probe sequence for 211184_s_at
agggccagataaggaacagctcggg

SEQ ID NO: 1728 - DNA, 25 bp, Artificial Sequence
  probe sequence for 211184_s_at
gatctcaaggatccagactctcatt

SEQ ID NO: 1729 - DNA, 25 bp, Artificial Sequence
  probe sequence for 211184_s_at
ctggcccagtgaatttggtctctcc

SEQ ID NO: 1730 - DNA, 25 bp, Artificial Sequence
  probe sequence for 211184_s_at
aataagaccccactggagtctctct

SEQ ID NO: 1731 - DNA, 25 bp, Artificial Sequence
  probe sequence for 211184_s_at
ctctgctctaattgctgccaggatt

SEQ ID NO: 1732 - DNA, 25 bp, Artificial Sequence
  probe sequence for 211184_s_at
tgccaggattgtcactccaaacctt

SEQ ID NO: 1733 - DNA, 25 bp, Artificial Sequence
  probe sequence for 215418_at
catctgtcccagtgactacagcttt

SEQ ID NO: 1734 - DNA, 25 bp, Artificial Sequence
  probe sequence for 215418_at
agtgactacagcttttaactcctcc

SEQ ID NO: 1735 - DNA, 25 bp, Artificial Sequence
  probe sequence for 215418_at
ctcctccagcagacatctagtcagg

SEQ ID NO: 1736 - DNA, 25 bp, Artificial Sequence
  probe sequence for 215418_at
gcaaggtagaacatggccacagagt

SEQ ID NO: 1737 - DNA, 25 bp, Artificial Sequence
  probe sequence for 215418_at
gaatcttgcctccaggaatggttac

SEQ ID NO: 1738 - DNA, 25 bp, Artificial Sequence
  probe sequence for 215418_at
aaccatccagcatcacatctatgca

SEQ ID NO: 1739 - DNA, 25 bp, Artificial Sequence
  probe sequence for 215418_at
atctatgcaaccccacgttaggcat

SEQ ID NO: 1740 - DNA, 25 bp, Artificial Sequence
  probe sequence for 215418_at
accccacgttaggcattgcgtacaa

SEQ ID NO: 1741 - DNA, 25 bp, Artificial Sequence
  probe sequence for 215418_at
gcagattagatcatttcacatttca

SEQ ID NO: 1742 - DNA, 25 bp, Artificial Sequence
  probe sequence for 215418_at
ggaggtgatgcttcttttgtgaact

SEQ ID NO: 1743 - DNA, 25 bp, Artificial Sequence
  probe sequence for 215418_at
aggtctgaggcagggcatacacatt

SEQ ID NO: 1744 - DNA, 25 bp, Artificial Sequence
  probe sequence for 207020_at
tgctcggccaccagggttttggtga

SEQ ID NO: 1745 - DNA, 25 bp, Artificial Sequence
  probe sequence for 207020_at
ttttggtgaaaatgccggtgtccct

SEQ ID NO: 1746 - DNA, 25 bp, Artificial Sequence
  probe sequence for 207020_at
cagatccctcatttgatactccaaa

SEQ ID NO: 1747 - DNA, 25 bp, Artificial Sequence
  probe sequence for 207020_at
ccaaaaccatcaccatgtaccatgt

SEQ ID NO: 1748 - DNA, 25 bp, Artificial Sequence
  probe sequence for 207020_at
gagagtgcttgtaggtggttggtta

SEQ ID NO: 1749 - DNA, 25 bp, Artificial Sequence
  probe sequence for 207020_at
gaggccatgaaagaacctgtccttc

SEQ ID NO: 1750 - DNA, 25 bp, Artificial Sequence
  probe sequence for 207020_at
ggaaaagtggtccatgtctgtgctg

SEQ ID NO: 1751 - DNA, 25 bp, Artificial Sequence
  probe sequence for 207020_at
agagggcttgcttagggcagcttct

SEQ ID NO: 1752 - DNA, 25 bp, Artificial Sequence
  probe sequence for 207020_at
gaccatgacctgtaggttcacctat

SEQ ID NO: 1753 - DNA, 25 bp, Artificial Sequence
  probe sequence for 207020_at
tgaataaccatctaccccattagtc

SEQ ID NO: 1754 - DNA, 25 bp, Artificial Sequence
  probe sequence for 207020_at
ttcattctctctctagtaattgtaa

SEQ ID NO: 1755 - DNA, 25 bp, Artificial Sequence
  probe sequence for 209393_s_at
tggtggcaagtggattattcggctg

SEQ ID NO: 1756 - DNA, 25 bp, Artificial Sequence
  probe sequence for 209393_s_at
attcggctgcggaagggcttggcct

SEQ ID NO: 1757 - DNA, 25 bp, Artificial Sequence
  probe sequence for 209393_s_at
ggcctcccgttgctgggagaatctc

SEQ ID NO: 1758 - DNA, 25 bp, Artificial Sequence
  probe sequence for 209393_s_at
gagaatctcattttggccatgctgg

SEQ ID NO: 1759 - DNA, 25 bp, Artificial Sequence
  probe sequence for 209393_s_at
gggggaacagttcatggttggggag

SEQ ID NO: 1760 - DNA, 25 bp, Artificial Sequence
  probe sequence for 209393_s_at
gttggggaggagatctgtggggctg

SEQ ID NO: 1761 - DNA, 25 bp, Artificial Sequence
  probe sequence for 209393_s_at
gtgtctgtccgctttcaggaagaca

SEQ ID NO: 1762 - DNA, 25 bp, Artificial Sequence
  probe sequence for 209393_s_at
agactgccagtgaccaagcaaccac

SEQ ID NO: 1763 - DNA, 25 bp, Artificial Sequence
  probe sequence for 209393_s_at
acagcccgaatccgggacacacttc

SEQ ID NO: 1764 - DNA, 25 bp, Artificial Sequence
  probe sequence for 209393_s_at
gacacacttcggcgagtgcttaacc

SEQ ID NO: 1765 - DNA, 25 bp, Artificial Sequence
  probe sequence for 209393_s_at
atacaaaactcacaccgacagcatc

SEQ ID NO: 1766 - DNA, 25 bp, Artificial Sequence
  probe sequence for 210101_x_at
gaatcagcagtacacatgcccatca

SEQ ID NO: 1767 - DNA, 25 bp, Artificial Sequence
  probe sequence for 210101_x_at
catcaccttcgctgtctgaatgact

SEQ ID NO: 1768 - DNA, 25 bp, Artificial Sequence
  probe sequence for 210101_x_at
agcccagatgacttactatgcacag

SEQ ID NO: 1769 - DNA, 25 bp, Artificial Sequence
  probe sequence for 210101_x_at
agttttccatccaattatcttagta

SEQ ID NO: 1770 - DNA, 25 bp, Artificial Sequence
  probe sequence for 210101_x_at
atcagacttctgtgacacctgtacc

SEQ ID NO: 1771 - DNA, 25 bp, Artificial Sequence
  probe sequence for 210101_x_at
gacacctgtaccatcagttttacca

SEQ ID NO: 1772 - DNA, 25 bp, Artificial Sequence
  probe sequence for 210101_x_at
ttggttcttctgccatggcttcaac

SEQ ID NO: 1773 - DNA, 25 bp, Artificial Sequence
  probe sequence for 210101_x_at
caagtggcctagtaatcacctctcc

SEQ ID NO: 1774 - DNA, 25 bp, Artificial Sequence
  probe sequence for 210101_x_at
ccttccaacctcagtgaccttaagg

SEQ ID NO: 1775 - DNA, 25 bp, Artificial Sequence
  probe sequence for 210101_x_at
aaaggccagggttctctatgattat

SEQ ID NO: 1776 - DNA, 25 bp, Artificial Sequence
  probe sequence for 210101_x_at
aaggttgcccatcatgactttgtat

SEQ ID NO: 1777 - DNA, 25 bp, Artificial Sequence
  probe sequence for 212052_s_at
gctgccttagacagattccctgggc

SEQ ID NO: 1778 - DNA, 25 bp, Artificial Sequence
  probe sequence for 212052_s_at
caccttccttacacctggtgggagc

SEQ ID NO: 1779 - DNA, 25 bp, Artificial Sequence
  probe sequence for 212052_s_at
tatgtggtatgggggtcattcctgc

SEQ ID NO: 1780 - DNA, 25 bp, Artificial Sequence
  probe sequence for 212052_s_at
aagtgatggaaccctcaggtgctct

SEQ ID NO: 1781 - DNA, 25 bp, Artificial Sequence
  probe sequence for 212052_s_at
agcctgaacctcctgactgaggaac

SEQ ID NO: 1782 - DNA, 25 bp, Artificial Sequence
  probe sequence for 212052_s_at
cacaggcgtggctgtacacgtgctc

SEQ ID NO: 1783 - DNA, 25 bp, Artificial Sequence
  probe sequence for 212052_s_at
ctcatcatcctttccagtaacttta

SEQ ID NO: 1784 - DNA, 25 bp, Artificial Sequence
  probe sequence for 212052_s_at
aaaaaacatccctcaggtcctgata

SEQ ID NO: 1785 - DNA, 25 bp, Artificial Sequence
  probe sequence for 212052_s_at
ggtcctgatatatttccttggattc

SEQ ID NO: 1786 - DNA, 25 bp, Artificial Sequence
  probe sequence for 212052_s_at
ttggctagaaattacactgtgctca

SEQ ID NO: 1787 - DNA, 25 bp, Artificial Sequence
  probe sequence for 212052_s_at
tgtgctcaatgccttaataaatccc

SEQ ID NO: 1788 - DNA, 25 bp, Artificial Sequence
  probe sequence for 204461_x_at
gatgaagttcttattctgagtacag

SEQ ID NO: 1789 - DNA, 25 bp, Artificial Sequence
  probe sequence for 204461_x_at
gagtacagtactctttgtcatttca

SEQ ID NO: 1790 - DNA, 25 bp, Artificial Sequence
  probe sequence for 204461_x_at
ggagcaaggtcatgtaccctaatag

SEQ ID NO: 1791 - DNA, 25 bp, Artificial Sequence
  probe sequence for 204461_x_at
gtcatagattattcaggactgtcct

SEQ ID NO: 1792 - DNA, 25 bp, Artificial Sequence
  probe sequence for 204461_x_at
ggactgtcctttagttctgtctttt

SEQ ID NO: 1793 - DNA, 25 bp, Artificial Sequence
  probe sequence for 204461_x_at
tctgtcttttgaactcatgggaata

SEQ ID NO: 1794 - DNA, 25 bp, Artificial Sequence
  probe sequence for 204461_x_at
gagtcagcgtaacatttcaagagtc

SEQ ID NO: 1795 - DNA, 25 bp, Artificial Sequence
  probe sequence for 204461_x_at
agagtctaaaggtggccgggtgtgg

SEQ ID NO: 1796 - DNA, 25 bp, Artificial Sequence
  probe sequence for 204461_x_at
aaaccagcctgaccaacgtggagaa

SEQ ID NO: 1797 - DNA, 25 bp, Artificial Sequence
  probe sequence for 204461_x_at
attagccggacgtggtggcacatgc

SEQ ID NO: 1798 - DNA, 25 bp, Artificial Sequence
  probe sequence for 204461_x_at
agctgaaatgacgccattgcactcc

SEQ ID NO: 1799 - DNA, 25 bp, Artificial Sequence
  probe sequence for 215011_at
ttgtactgagctgagaccttgccac

SEQ ID NO: 1800 - DNA, 25 bp, Artificial Sequence
  probe sequence for 215011_at
ttgtatttgtgcttacctgtgccag

SEQ ID NO: 1801 - DNA, 25 bp, Artificial Sequence
  probe sequence for 215011_at
actgttctaggtaagcactaagtgg

SEQ ID NO: 1802 - DNA, 25 bp, Artificial Sequence
  probe sequence for 215011_at
gtgggctttaatacagcatattcca

SEQ ID NO: 1803 - DNA, 25 bp, Artificial Sequence
  probe sequence for 215011_at
gcatattccaatggggaatcccagg

SEQ ID NO: 1804 - DNA, 25 bp, Artificial Sequence
  probe sequence for 215011_at
gaatcccaggaaccaaaagactaat

SEQ ID NO: 1805 - DNA, 25 bp, Artificial Sequence
  probe sequence for 215011_at
aagactaattgtccaagtccacaac

SEQ ID NO: 1806 - DNA, 25 bp, Artificial Sequence
  probe sequence for 215011_at
aattgtccaagtccacaactagaag

SEQ ID NO: 1807 - DNA, 25 bp, Artificial Sequence
  probe sequence for 215011_at
gcagaaacaagcatcaaattccctg

SEQ ID NO: 1808 - DNA, 25 bp, Artificial Sequence
  probe sequence for 215011_at
caagcatcaaattccctgctcagga

SEQ ID NO: 1809 - DNA, 25 bp, Artificial Sequence
  probe sequence for 215011_at
aaattccctgctcaggaagaagcca

SEQ ID NO: 1810 - DNA, 25 bp, Artificial Sequence
  probe sequence for 205367_at
gccagtgtcacgtacagcatctgtg

SEQ ID NO: 1811 - DNA, 25 bp, Artificial Sequence
  probe sequence for 205367_at
gtgtcacgtacagcatctgtggttc

SEQ ID NO: 1812 - DNA, 25 bp, Artificial Sequence
  probe sequence for 205367_at
gtcacgtacagcatctgtggttcca

SEQ ID NO: 1813 - DNA, 25 bp, Artificial Sequence
  probe sequence for 205367_at
cacgtacagcatctgtggttccagt

SEQ ID NO: 1814 - DNA, 25 bp, Artificial Sequence
  probe sequence for 205367_at
gtacagcatctgtggttccagtctg

SEQ ID NO: 1815 - DNA, 25 bp, Artificial Sequence
  probe sequence for 205367_at
cagcatctgtggttccagtctgtgc

SEQ ID NO: 1816 - DNA, 25 bp, Artificial Sequence
  probe sequence for 205367_at
agcatctgtggttccagtctgtgct

SEQ ID NO: 1817 - DNA, 25 bp, Artificial Sequence
  probe sequence for 205367_at
caccccatcccactggagtcagggg

SEQ ID NO: 1818 - DNA, 25 bp, Artificial Sequence
  probe sequence for 205367_at
ccccatcccactggagtcagggggc

SEQ ID NO: 1819 - DNA, 25 bp, Artificial Sequence
  probe sequence for 205367_at
cgccgtggagaaccagtactccttc

SEQ ID NO: 1820 - DNA, 25 bp, Artificial Sequence
  probe sequence for 205367_at
ccgtggagaaccagtactccttcta

SEQ ID NO: 1821 - DNA, 25 bp, Artificial Sequence
  probe sequence for 219203_at
cctgtccgtcatgttggaggtcgcc

SEQ ID NO: 1822 - DNA, 25 bp, Artificial Sequence
  probe sequence for 219203_at
tcgccctcaaccaggtggatgtgtg

SEQ ID NO: 1823 - DNA, 25 bp, Artificial Sequence
  probe sequence for 219203_at
gtctggtggtggctggttactacca

SEQ ID NO: 1824 - DNA, 25 bp, Artificial Sequence
  probe sequence for 219203_at
gttactaccatgccaatgcagctgt

SEQ ID NO: 1825 - DNA, 25 bp, Artificial Sequence
  probe sequence for 219203_at
gcagctgtgaacgatcagagccctg

SEQ ID NO: 1826 - DNA, 25 bp, Artificial Sequence
  probe sequence for 219203_at
gaattcttccctgatgcagtactta

SEQ ID NO: 1827 - DNA, 25 bp, Artificial Sequence
  probe sequence for 219203_at
tctccgctgggtccctaaggataag

SEQ ID NO: 1828 - DNA, 25 bp, Artificial Sequence
  probe sequence for 219203_at
ggcagatggtgggagctctactgga

SEQ ID NO: 1829 - DNA, 25 bp, Artificial Sequence
  probe sequence for 219203_at
tactggaagatcgggcccaccagca

SEQ ID NO: 1830 - DNA, 25 bp, Artificial Sequence
  probe sequence for 219203_at
cagcaccttgtggactttgactgcc

SEQ ID NO: 1831 - DNA, 25 bp, Artificial Sequence
  probe sequence for 219203_at
tgccaccttgatgacatccggcagg

SEQ ID NO: 1832 - DNA, 25 bp, Artificial Sequence
  probe sequence for 215067_x_at
aacaaacaggccgagcgcggtggct

SEQ ID NO: 1833 - DNA, 25 bp, Artificial Sequence
  probe sequence for 215067_x_at
gagactcccttgaacccgggaggag

SEQ ID NO: 1834 - DNA, 25 bp, Artificial Sequence
  probe sequence for 215067_x_at
cagtaagccgagatcacaccactgc

SEQ ID NO: 1835 - DNA, 25 bp, Artificial Sequence
  probe sequence for 215067_x_at
tccagcctgggcgccagtgtgagac

SEQ ID NO: 1836 - DNA, 25 bp, Artificial Sequence
  probe sequence for 215067_x_at
gtaggggtggggcagagggacaaag

SEQ ID NO: 1837 - DNA, 25 bp, Artificial Sequence
  probe sequence for 215067_x_at
caggaagatgctgtgtctcatgcct

SEQ ID NO: 1838 - DNA, 25 bp, Artificial Sequence
  probe sequence for 215067_x_at
gtctcatgcctgtagatgctgtgtc

SEQ ID NO: 1839 - DNA, 25 bp, Artificial Sequence
  probe sequence for 215067_x_at
tgcctgtagatgctgtgtctcatgc

SEQ ID NO: 1840 - DNA, 25 bp, Artificial Sequence
  probe sequence for 215067_x_at
tagttccacctactctggagagtga

SEQ ID NO: 1841 - DNA, 25 bp, Artificial Sequence
  probe sequence for 215067_x_at
aggaatttgagtcgagcctaggcaa

SEQ ID NO: 1842 - DNA, 25 bp, Artificial Sequence
  probe sequence for 215067_x_at
taggcaacatagcaataccccatct

SEQ ID NO: 1843 - DNA, 25 bp, Artificial Sequence
  probe sequence for 221932_s_at
agcagagagggagccgttcatgtca

SEQ ID NO: 1844 - DNA, 25 bp, Artificial Sequence
  probe sequence for 221932_s_at
gttcatgtcagagactcactgccag

SEQ ID NO: 1845 - DNA, 25 bp, Artificial Sequence
  probe sequence for 221932_s_at
cactgccagaaaagccttacccatt

SEQ ID NO: 1846 - DNA, 25 bp, Artificial Sequence
  probe sequence for 221932_s_at
ttgagaccgcaactgcttgcactga

SEQ ID NO: 1847 - DNA, 25 bp, Artificial Sequence
  probe sequence for 221932_s_at
ttttagttggtctggtgttcgggct

SEQ ID NO: 1848 - DNA, 25 bp, Artificial Sequence
  probe sequence for 221932_s_at
gtcacttattctttgcctgattcag

SEQ ID NO: 1849 - DNA, 25 bp, Artificial Sequence
  probe sequence for 221932_s_at
gaatcattattcatgacccctctgc

SEQ ID NO: 1850 - DNA, 25 bp, Artificial Sequence
  probe sequence for 221932_s_at
gacccctctgcaaatgtgtcagtct

SEQ ID NO: 1851 - DNA, 25 bp, Artificial Sequence
  probe sequence for 221932_s_at
gtctccaaagagagtatctcccccc

SEQ ID NO: 1852 - DNA, 25 bp, Artificial Sequence
  probe sequence for 221932_s_at
atctccccccaaattttgtgtagct

SEQ ID NO: 1853 - DNA, 25 bp, Artificial Sequence
  probe sequence for 221932_s_at
tgtgcatgcctgagttgattccgaa

SEQ ID NO: 1854 - DNA, 25 bp, Artificial Sequence
  probe sequence for 201239_s_at
tggtctaattgatggtcgcctcacc

SEQ ID NO: 1855 - DNA, 25 bp, Artificial Sequence
  probe sequence for 201239_s_at
catctgtacaatctcctgtttcttt

SEQ ID NO: 1856 - DNA, 25 bp, Artificial Sequence
  probe sequence for 201239_s_at
ctcctgtttctttgccatagtggct

SEQ ID NO: 1857 - DNA, 25 bp, Artificial Sequence
  probe sequence for 201239_s_at
tttgggattatatgcacccctttcc

SEQ ID NO: 1858 - DNA, 25 bp, Artificial Sequence
  probe sequence for 201239_s_at
tccagagtccaaacccgttttggct

SEQ ID NO: 1859 - DNA, 25 bp, Artificial Sequence
  probe sequence for 201239_s_at
ttggctttgtgtgtcatatcctatt

SEQ ID NO: 1860 - DNA, 25 bp, Artificial Sequence
  probe sequence for 201239_s_at
gagaagagcatctttctcgtggccc

SEQ ID NO: 1861 - DNA, 25 bp, Artificial Sequence
  probe sequence for 201239_s_at
tctcgtggcccacaggaaagatcct

SEQ ID NO: 1862 - DNA, 25 bp, Artificial Sequence
  probe sequence for 201239_s_at
gatgatatttggcagctgtcctcca

SEQ ID NO: 1863 - DNA, 25 bp, Artificial Sequence
  probe sequence for 201239_s_at
gaagccgagttcacaaagtccattg

SEQ ID NO: 1864 - DNA, 25 bp, Artificial Sequence
  probe sequence for 201239_s_at
tccaggctccatgacagtcttgcca

SEQ ID NO: 1865 - DNA, 25 bp, Artificial Sequence
  probe sequence for 212517_at
ggtggtttctagatagccaggccca

SEQ ID NO: 1866 - DNA, 25 bp, Artificial Sequence
  probe sequence for 212517_at
aggcccaccaagagatattgcccct

SEQ ID NO: 1867 - DNA, 25 bp, Artificial Sequence
  probe sequence for 212517_at
gagatattgccccttgatgagagtc

SEQ ID NO: 1868 - DNA, 25 bp, Artificial Sequence
  probe sequence for 212517_at
cttgatgagagtcaaacaccctgcc

SEQ ID NO: 1869 - DNA, 25 bp, Artificial Sequence
  probe sequence for 212517_at
gaggaaaattggcacctcatctttt

SEQ ID NO: 1870 - DNA, 25 bp, Artificial Sequence
  probe sequence for 212517_at
ggcacctcatcttttaaaggcagta

SEQ ID NO: 1871 - DNA, 25 bp, Artificial Sequence
  probe sequence for 212517_at
acactagtgaagcctgtttcgttga

SEQ ID NO: 1872 - DNA, 25 bp, Artificial Sequence
  probe sequence for 212517_at
ttacgatttcgtttgtttggattca

SEQ ID NO: 1873 - DNA, 25 bp, Artificial Sequence
  probe sequence for 212517_at
atttagcatctattacactcatgta

SEQ ID NO: 1874 - DNA, 25 bp, Artificial Sequence
  probe sequence for 212517_at
tcattgcggggattgtgggtgttat

SEQ ID NO: 1875 - DNA, 25 bp, Artificial Sequence
  probe sequence for 212517_at
gaactaagggaggtctgtgcatttt

SEQ ID NO: 1876 - DNA, 25 bp, Artificial Sequence
  probe sequence for 220215_at
caatgtgatcaagccttcagtcgcc

SEQ ID NO: 1877 - DNA, 25 bp, Artificial Sequence
  probe sequence for 220215_at
tcccttcacctccacgaaagaattc

SEQ ID NO: 1878 - DNA, 25 bp, Artificial Sequence
  probe sequence for 220215_at
tcacctccacgaaagaattcatact

SEQ ID NO: 1879 - DNA, 25 bp, Artificial Sequence
  probe sequence for 220215_at
aatgcggtaaagcctacactcgttc

SEQ ID NO: 1880 - DNA, 25 bp, Artificial Sequence
  probe sequence for 220215_at
agtcaccttactcgccatgaaagaa

SEQ ID NO: 1881 - DNA, 25 bp, Artificial Sequence
  probe sequence for 220215_at
accttactcgccatgaaagaagtca

SEQ ID NO: 1882 - DNA, 25 bp, Artificial Sequence
  probe sequence for 220215_at
gaagtcatgatatagaggctgggtg

SEQ ID NO: 1883 - DNA, 25 bp, Artificial Sequence
  probe sequence for 220215_at
gctgggtgtagtgactcagcctata

SEQ ID NO: 1884 - DNA, 25 bp, Artificial Sequence
  probe sequence for 220215_at
ggtgtagtgactcagcctataatcc

SEQ ID NO: 1885 - DNA, 25 bp, Artificial Sequence
  probe sequence for 220215_at
aacaatgtgaaacaacctgggcaac

SEQ ID NO: 1886 - DNA, 25 bp, Artificial Sequence
  probe sequence for 220215_at
aataaaataatgccgggcacggtgg

SEQ ID NO: 1887 - DNA, 25 bp, Artificial Sequence
  probe sequence for 201923_at
gtgtccaactgaaattatcgctttt

SEQ ID NO: 1888 - DNA, 25 bp, Artificial Sequence
  probe sequence for 201923_at
gtagcatgctctgttgattcacagt

SEQ ID NO: 1889 - DNA, 25 bp, Artificial Sequence
  probe sequence for 201923_at
gattcacagtttacccatttggcct

SEQ ID NO: 1890 - DNA, 25 bp, Artificial Sequence
  probe sequence for 201923_at
tggattaatacccctcgaagacaag

SEQ ID NO: 1891 - DNA, 25 bp, Artificial Sequence
  probe sequence for 201923_at
taaggattccacttctttcagattt

SEQ ID NO: 1892 - DNA, 25 bp, Artificial Sequence
  probe sequence for 201923_at
gacccatcagatctcaaaggactat

SEQ ID NO: 1893 - DNA, 25 bp, Artificial Sequence
  probe sequence for 201923_at
aggccacactcttagaggtctcttc

SEQ ID NO: 1894 - DNA, 25 bp, Artificial Sequence
  probe sequence for 201923_at
tactctgaatgatcttcctgtgggt

SEQ ID NO: 1895 - DNA, 25 bp, Artificial Sequence
  probe sequence for 201923_at
ggatgagacactacgtttggttcaa

SEQ ID NO: 1896 - DNA, 25 bp, Artificial Sequence
  probe sequence for 201923_at
gtttggttcaagcattccagtacac

SEQ ID NO: 1897 - DNA, 25 bp, Artificial Sequence
  probe sequence for 201923_at
gaaacaataatcccagatccagctg

SEQ ID NO: 1898 - DNA, 25 bp, Artificial Sequence
  probe sequence for 215553_x_at
gcaccatgctgagcctgggaggtaa

SEQ ID NO: 1899 - DNA, 25 bp, Artificial Sequence
  probe sequence for 215553_x_at
tgaatgagtggaccttgtgggttcc

SEQ ID NO: 1900 - DNA, 25 bp, Artificial Sequence
  probe sequence for 215553_x_at
accttgtgggttccatgctagttaa

SEQ ID NO: 1901 - DNA, 25 bp, Artificial Sequence
  probe sequence for 215553_x_at
taaagacaccctatgagaccagcct

SEQ ID NO: 1902 - DNA, 25 bp, Artificial Sequence
  probe sequence for 215553_x_at
gggccaggcaaggtgggtcacacct

SEQ ID NO: 1903 - DNA, 25 bp, Artificial Sequence
  probe sequence for 215553_x_at
gaatcacttgagtccggcagtttga

SEQ ID NO: 1904 - DNA, 25 bp, Artificial Sequence
  probe sequence for 215553_x_at
aacataatgagaccgcatcttcaca

SEQ ID NO: 1905 - DNA, 25 bp, Artificial Sequence
  probe sequence for 215553_x_at
gagaccgcatcttcacaaaaaatat

SEQ ID NO: 1906 - DNA, 25 bp, Artificial Sequence
  probe sequence for 215553_x_at
atggtgaagtgtgcctgtggtccca

SEQ ID NO: 1907 - DNA, 25 bp, Artificial Sequence
  probe sequence for 215553_x_at
gagtattgcctgagcccaggagttc

SEQ ID NO: 1908 - DNA, 25 bp, Artificial Sequence
  probe sequence for 215553_x_at
ggctgcagtgaactgtgatcacacc

SEQ ID NO: 1909 - DNA, 25 bp, Artificial Sequence
  probe sequence for 215609_at
gatgcttcagtaagcccagatcaca

SEQ ID NO: 1910 - DNA, 25 bp, Artificial Sequence
  probe sequence for 215609_at
atgcttcagtaagcccagatcacac

SEQ ID NO: 1911 - DNA, 25 bp, Artificial Sequence
  probe sequence for 215609_at
aaaaagacatagagccaggcgcctg

SEQ ID NO: 1912 - DNA, 25 bp, Artificial Sequence
  probe sequence for 215609_at
gccaaggcgtgaggactgtttgagg

SEQ ID NO: 1913 - DNA, 25 bp, Artificial Sequence
  probe sequence for 215609_at
aggcgtgaggactgtttgaggtcag

SEQ ID NO: 1914 - DNA, 25 bp, Artificial Sequence
  probe sequence for 215609_at
gcgtgaggactgtttgaggtcagga

SEQ ID NO: 1915 - DNA, 25 bp, Artificial Sequence
  probe sequence for 215609_at
agccactggcaaggctgaggcacga

SEQ ID NO: 1916 - DNA, 25 bp, Artificial Sequence
  probe sequence for 215609_at
ggaggctgcggtgaggtgagatcac

SEQ ID NO: 1917 - DNA, 25 bp, Artificial Sequence
  probe sequence for 215609_at
agagtgagattatgtcttaagaaaa

SEQ ID NO: 1918 - DNA, 25 bp, Artificial Sequence
  probe sequence for 215609_at
aaagagtctgggcgtgatgtctcat

SEQ ID NO: 1919 - DNA, 25 bp, Artificial Sequence
  probe sequence for 215609_at
gagtctgggcgtgatgtctcatgcc

SEQ ID NO: 1920 - DNA, 25 bp, Artificial Sequence
  probe sequence for 207984_s_at
gcgccatttacactgtagtctgtac

SEQ ID NO: 1921 - DNA, 25 bp, Artificial Sequence
  probe sequence for 207984_s_at
acaacctgtggttccacgtgcatgt

SEQ ID NO: 1922 - DNA, 25 bp, Artificial Sequence
  probe sequence for 207984_s_at
ctgtgcctctggcaccaggttgtgt

SEQ ID NO: 1923 - DNA, 25 bp, Artificial Sequence
  probe sequence for 207984_s_at
atcagccctcatttcttataatacc

SEQ ID NO: 1924 - DNA, 25 bp, Artificial Sequence
  probe sequence for 207984_s_at
ttataataccctgatcccagactcc

SEQ ID NO: 1925 - DNA, 25 bp, Artificial Sequence
  probe sequence for 207984_s_at
gcccccctgccataacttggggagg

SEQ ID NO: 1926 - DNA, 25 bp, Artificial Sequence
  probe sequence for 207984_s_at
aatgctgtcctagatgtacttgggc

SEQ ID NO: 1927 - DNA, 25 bp, Artificial Sequence
  probe sequence for 207984_s_at
tcccagttcttccaagtgtctaact

SEQ ID NO: 1928 - DNA, 25 bp, Artificial Sequence
  probe sequence for 207984_s_at
ctaactagtcttcgctgcagcgtca

SEQ ID NO: 1929 - DNA, 25 bp, Artificial Sequence
  probe sequence for 207984_s_at
cgctgcagcgtcagccaaagctggc

SEQ ID NO: 1930 - DNA, 25 bp, Artificial Sequence
  probe sequence for 207984_s_at
gtgtgcccatttcctagggaagggg

SEQ ID NO: 1931 - DNA, 25 bp, Artificial Sequence
  probe sequence for 215373_x_at
atgaggccaggggcagtggctctct

SEQ ID NO: 1932 - DNA, 25 bp, Artificial Sequence
  probe sequence for 215373_x_at
ccaacacttcaggaaagccgggagg

SEQ ID NO: 1933 - DNA, 25 bp, Artificial Sequence
  probe sequence for 215373_x_at
gaaagccgggaggaaggatcgctta

SEQ ID NO: 1934 - DNA, 25 bp, Artificial Sequence
  probe sequence for 215373_x_at
gaaggatcgcttaaggacaggagtt

SEQ ID NO: 1935 - DNA, 25 bp, Artificial Sequence
  probe sequence for 215373_x_at
agcctaagcaacagatccagaccct

SEQ ID NO: 1936 - DNA, 25 bp, Artificial Sequence
  probe sequence for 215373_x_at
ggtgtggtggcgtacacctttggtc

SEQ ID NO: 1937 - DNA, 25 bp, Artificial Sequence
  probe sequence for 215373_x_at
gaaggaggaggattgctggagccca

SEQ ID NO: 1938 - DNA, 25 bp, Artificial Sequence
  probe sequence for 215373_x_at
gagccatgactgtgacactgcactc

SEQ ID NO: 1939 - DNA, 25 bp, Artificial Sequence
  probe sequence for 215373_x_at
gaaaacatgaccaggcatggtggct

SEQ ID NO: 1940 - DNA, 25 bp, Artificial Sequence
  probe sequence for 215373_x_at
cccaggaggtggagtttgcagtagg

SEQ ID NO: 1941 - DNA, 25 bp, Artificial Sequence
  probe sequence for 215373_x_at
tttgcagtaggccaagatcgcacca

SEQ ID NO: 1942 - DNA, 25 bp, Artificial Sequence
  probe sequence for 216110_x_at
attcttctaaataactcatgagtcc

SEQ ID NO: 1943 - DNA, 25 bp, Artificial Sequence
  probe sequence for 216110_x_at
gaagagttccttctcagtttctagc

SEQ ID NO: 1944 - DNA, 25 bp, Artificial Sequence
  probe sequence for 216110_x_at
gttccttctcagtttctagcatatg

SEQ ID NO: 1945 - DNA, 25 bp, Artificial Sequence
  probe sequence for 216110_x_at
ttctcagtttctagcatatgatgat

SEQ ID NO: 1946 - DNA, 25 bp, Artificial Sequence
  probe sequence for 216110_x_at
aatagtgaaaatgtcctagctttct

SEQ ID NO: 1947 - DNA, 25 bp, Artificial Sequence
  probe sequence for 216110_x_at
aatgtcctagctttctttaaataat

SEQ ID NO: 1948 - DNA, 25 bp, Artificial Sequence
  probe sequence for 216110_x_at
gaggggctgggcataatggctcaca

SEQ ID NO: 1949 - DNA, 25 bp, Artificial Sequence
  probe sequence for 216110_x_at
cccaacactttaagaggctgagatg

SEQ ID NO: 1950 - DNA, 25 bp, Artificial Sequence
  probe sequence for 216110_x_at
gagatggaaggattccttcagccca

SEQ ID NO: 1951 - DNA, 25 bp, Artificial Sequence
  probe sequence for 216110_x_at
gattccttcagcccaggagtttgaa

SEQ ID NO: 1952 - DNA, 25 bp, Artificial Sequence
  probe sequence for 216110_x_at
tcagcccaggagtttgaaaccagcc

SEQ ID NO: 1953 - DNA, 25 bp, Artificial Sequence
  probe sequence for 213351_s_at
tggaagtcactttgatagatggatt

SEQ ID NO: 1954 - DNA, 25 bp, Artificial Sequence
  probe sequence for 213351_s_at
cctccagccaaatagtcccatgctg

SEQ ID NO: 1955 - DNA, 25 bp, Artificial Sequence
  probe sequence for 213351_s_at
aaatagtcccatgctgactttctat

SEQ ID NO: 1956 - DNA, 25 bp, Artificial Sequence
  probe sequence for 213351_s_at
aaactgtcttaggaaggaccttcag

SEQ ID NO: 1957 - DNA, 25 bp, Artificial Sequence
  probe sequence for 213351_s_at
caccagacccagaagttgtacgcat

SEQ ID NO: 1958 - DNA, 25 bp, Artificial Sequence
  probe sequence for 213351_s_at
gacccagaagttgtacgcatttaat

SEQ ID NO: 1959 - DNA, 25 bp, Artificial Sequence
  probe sequence for 213351_s_at
ttgtcttgtcagagctcttctataa

SEQ ID NO: 1960 - DNA, 25 bp, Artificial Sequence
  probe sequence for 213351_s_at
gtcagagctcttctataacctcgct

SEQ ID NO: 1961 - DNA, 25 bp, Artificial Sequence
  probe sequence for 213351_s_at
tcttctataacctcgctctaatggc

SEQ ID NO: 1962 - DNA, 25 bp, Artificial Sequence
  probe sequence for 213351_s_at
aacctcgctctaatggcttaacagt

SEQ ID NO: 1963 - DNA, 25 bp, Artificial Sequence
  probe sequence for 213351_s_at
taatggcttaacagttgttctgggt

SEQ ID NO: 1964 - DNA, 25 bp, Artificial Sequence
  probe sequence for 202021_x_at
agcaataccgtcatgtttcagccaa

SEQ ID NO: 1965 - DNA, 25 bp, Artificial Sequence
  probe sequence for 202021_x_at
caagcccagagccctaagattacaa

SEQ ID NO: 1966 - DNA, 25 bp, Artificial Sequence
  probe sequence for 202021_x_at
gttaccacctgaacagtcctcggtg

SEQ ID NO: 1967 - DNA, 25 bp, Artificial Sequence
  probe sequence for 202021_x_at
ggcagaagcaccagctgtactacta

SEQ ID NO: 1968 - DNA, 25 bp, Artificial Sequence
  probe sequence for 202021_x_at
ggtgtctccaacctgactaggtgga

SEQ ID NO: 1969 - DNA, 25 bp, Artificial Sequence
  probe sequence for 202021_x_at
gccctcttaccgctagcgaggtgat

SEQ ID NO: 1970 - DNA, 25 bp, Artificial Sequence
  probe sequence for 202021_x_at
gtgataggacatctggcttgccaca

SEQ ID NO: 1971 - DNA, 25 bp, Artificial Sequence
  probe sequence for 202021_x_at
gcttgccacaaaggtctgttcgacc

SEQ ID NO: 1972 - DNA, 25 bp, Artificial Sequence
  probe sequence for 202021_x_at
gttcgaccagacatatcctagctaa

SEQ ID NO: 1973 - DNA, 25 bp, Artificial Sequence
  probe sequence for 202021_x_at
gaatgtgaggccaaccttctatcag

SEQ ID NO: 1974 - DNA, 25 bp, Artificial Sequence
  probe sequence for 202021_x_at
cagctgcccaatgccatgtgaagta

SEQ ID NO: 1975 - DNA, 25 bp, Artificial Sequence
  probe sequence for 215600_x_at
gagcctgggaggttgaggctgcagt

SEQ ID NO: 1976 - DNA, 25 bp, Artificial Sequence
  probe sequence for 215600_x_at
gctgcagtgagtcaagattgcacca

SEQ ID NO: 1977 - DNA, 25 bp, Artificial Sequence
  probe sequence for 215600_x_at
ttgagggcagggtggtggcacacgc

SEQ ID NO: 1978 - DNA, 25 bp, Artificial Sequence
  probe sequence for 215600_x_at
gagctcaggaggttgaagctgcagt

SEQ ID NO: 1979 - DNA, 25 bp, Artificial Sequence
  probe sequence for 215600_x_at
aagctgcagtgagatgtgtttgcgc

SEQ ID NO: 1980 - DNA, 25 bp, Artificial Sequence
  probe sequence for 215600_x_at
agtgagatgtgtttgcgccactgca

SEQ ID NO: 1981 - DNA, 25 bp, Artificial Sequence
  probe sequence for 215600_x_at
tgcactccagcttgggtgacggagc

SEQ ID NO: 1982 - DNA, 25 bp, Artificial Sequence
  probe sequence for 215600_x_at
ttgggtgacggagcgagaccctgtc

SEQ ID NO: 1983 - DNA, 25 bp, Artificial Sequence
  probe sequence for 215600_x_at
gaattgcagtaaaaccgtgtgcttc

SEQ ID NO: 1984 - DNA, 25 bp, Artificial Sequence
  probe sequence for 215600_x_at
aaaccgtgtgcttctatgaggggat

SEQ ID NO: 1985 - DNA, 25 bp, Artificial Sequence
  probe sequence for 215600_x_at
atttacttgtggctgggcacggtgg

SEQ ID NO: 1986 - DNA, 25 bp, Artificial Sequence
  probe sequence for 209442_x_at
gattccattacctcatatctcaaag

SEQ ID NO: 1987 - DNA, 25 bp, Artificial Sequence
  probe sequence for 209442_x_at
gaagccatacagaaatcactccaga

SEQ ID NO: 1988 - DNA, 25 bp, Artificial Sequence
  probe sequence for 209442_x_at
caaaatcttactttccagaatccca

SEQ ID NO: 1989 - DNA, 25 bp, Artificial Sequence
  probe sequence for 209442_x_at
agcatcaccactagcagcatatcag

SEQ ID NO: 1990 - DNA, 25 bp, Artificial Sequence
  probe sequence for 209442_x_at
agaagagactaaaccctgtgtgcct

SEQ ID NO: 1991 - DNA, 25 bp, Artificial Sequence
  probe sequence for 209442_x_at
aaccctgtgtgcctgtcagtatgaa

SEQ ID NO: 1992 - DNA, 25 bp, Artificial Sequence
  probe sequence for 209442_x_at
ggacttctccagcagatggcaagcc

SEQ ID NO: 1993 - DNA, 25 bp, Artificial Sequence
  probe sequence for 209442_x_at
gcaagccaaggcttagcctccatga

SEQ ID NO: 1994 - DNA, 25 bp, Artificial Sequence
  probe sequence for 209442_x_at
gaagaggggtccagtgggtctgagc

SEQ ID NO: 1995 - DNA, 25 bp, Artificial Sequence
  probe sequence for 209442_x_at
gagccactcgtaacagcgaacggtc

SEQ ID NO: 1996 - DNA, 25 bp, Artificial Sequence
  probe sequence for 209442_x_at
gaagtgtgtgtgtgttcgctgcttc

SEQ ID NO: 1997 - DNA, 25 bp, Artificial Sequence
  probe sequence for 210131_x_at
atgaggtggctgcaaaaactcccct

SEQ ID NO: 1998 - DNA, 25 bp, Artificial Sequence
  probe sequence for 210131_x_at
cctactctcggcctagaagcagtta

SEQ ID NO: 1999 - DNA, 25 bp, Artificial Sequence
  probe sequence for 210131_x_at
gttattctctctccatattgggctt

SEQ ID NO: 2000 - DNA, 25 bp, Artificial Sequence
  probe sequence for 210131_x_at
tgctgagggtcagcttttggctcct

SEQ ID NO: 2001 - DNA, 25 bp, Artificial Sequence
  probe sequence for 210131_x_at
gctccttcttcctgagacagtggaa

SEQ ID NO: 2002 - DNA, 25 bp, Artificial Sequence
  probe sequence for 210131_x_at
aacaatgccagctctgtggcttctg

SEQ ID NO: 2003 - DNA, 25 bp, Artificial Sequence
  probe sequence for 210131_x_at
ttggtgaggctttgggtgccactgc

SEQ ID NO: 2004 - DNA, 25 bp, Artificial Sequence
  probe sequence for 210131_x_at
actgcctgtgggttgctggcttaaa

SEQ ID NO: 2005 - DNA, 25 bp, Artificial Sequence
  probe sequence for 210131_x_at
gtgagagcccaggccattaacacct

SEQ ID NO: 2006 - DNA, 25 bp, Artificial Sequence
  probe sequence for 210131_x_at
ggaattagtctgtcccagctagagg

SEQ ID NO: 2007 - DNA, 25 bp, Artificial Sequence
  probe sequence for 210131_x_at
agttagttcttggagcagctgcttt

SEQ ID NO: 2008 - DNA, 25 bp, Artificial Sequence
  probe sequence for 217713_x_at
ctccgtggctcgtgcttttagccac

SEQ ID NO: 2009 - DNA, 25 bp, Artificial Sequence
  probe sequence for 217713_x_at
gtggctcgtgcttttagccactagg

SEQ ID NO: 2010 - DNA, 25 bp, Artificial Sequence
  probe sequence for 217713_x_at
tagccactaggctttgctgtgtaaa

SEQ ID NO: 2011 - DNA, 25 bp, Artificial Sequence
  probe sequence for 217713_x_at
aagaaagcgttgcaggctgggcgtg

SEQ ID NO: 2012 - DNA, 25 bp, Artificial Sequence
  probe sequence for 217713_x_at
gtgggcggagaatcacttgagctca

SEQ ID NO: 2013 - DNA, 25 bp, Artificial Sequence
  probe sequence for 217713_x_at
tgcctgaagtcccagcttcttggga

SEQ ID NO: 2014 - DNA, 25 bp, Artificial Sequence
  probe sequence for 217713_x_at
tgaagtcccagcttcttgggaggct

SEQ ID NO: 2015 - DNA, 25 bp, Artificial Sequence
  probe sequence for 217713_x_at
gaggcagcataattgcttgaacctg

SEQ ID NO: 2016 - DNA, 25 bp, Artificial Sequence
  probe sequence for 217713_x_at
gggttgcagtgagcctagatagtgc

SEQ ID NO: 2017 - DNA, 25 bp, Artificial Sequence
  probe sequence for 217713_x_at
gagcctagatagtgccactacactc

SEQ ID NO: 2018 - DNA, 25 bp, Artificial Sequence
  probe sequence for 217713_x_at
gaaagcattgccatttctatggatt

SEQ ID NO: 2019 - DNA, 25 bp, Artificial Sequence
  probe sequence for 214707_x_at
caccaagtggtcgggagctctggct

SEQ ID NO: 2020 - DNA, 25 bp, Artificial Sequence
  probe sequence for 214707_x_at
agctctggcttgcacccagaataaa

SEQ ID NO: 2021 - DNA, 25 bp, Artificial Sequence
  probe sequence for 214707_x_at
gagtcatttctcacttatggcactg

SEQ ID NO: 2022 - DNA, 25 bp, Artificial Sequence
  probe sequence for 214707_x_at
aacttctcactaatttgcatgtctt

SEQ ID NO: 2023 - DNA, 25 bp, Artificial Sequence
  probe sequence for 214707_x_at
catgtcttaggctcctctttattag

SEQ ID NO: 2024 - DNA, 25 bp, Artificial Sequence
  probe sequence for 214707_x_at
tttaggccaggtacggtggctcatg

SEQ ID NO: 2025 - DNA, 25 bp, Artificial Sequence
  probe sequence for 214707_x_at
ttagggaggccgaggtgtgcagatc

SEQ ID NO: 2026 - DNA, 25 bp, Artificial Sequence
  probe sequence for 214707_x_at
gaaactccatctctactcaaaatac

SEQ ID NO: 2027 - DNA, 25 bp, Artificial Sequence
  probe sequence for 214707_x_at
tgtggaggcacacgcctgtaatccc

SEQ ID NO: 2028 - DNA, 25 bp, Artificial Sequence
  probe sequence for 214707_x_at
agccgggaggatctcttgaacctgg

SEQ ID NO: 2029 - DNA, 25 bp, Artificial Sequence
  probe sequence for 214707_x_at
gagcttagatggtgccactgtactc

SEQ ID NO: 2030 - DNA, 25 bp, Artificial Sequence
  probe sequence for 216922_x_at
agtcgccactggatatcagttccct

SEQ ID NO: 2031 - DNA, 25 bp, Artificial Sequence
  probe sequence for 216922_x_at
ttatcagccatttcctgcttatcca

SEQ ID NO: 2032 - DNA, 25 bp, Artificial Sequence
  probe sequence for 216922_x_at
agttcaccatttcaggtcactgctg

SEQ ID NO: 2033 - DNA, 25 bp, Artificial Sequence
  probe sequence for 216922_x_at
tttcctgcttatccaaattcaccat

SEQ ID NO: 2034 - DNA, 25 bp, Artificial Sequence
  probe sequence for 216922_x_at
ttcaccatttcaagtcgccactgga

SEQ ID NO: 2035 - DNA, 25 bp, Artificial Sequence
  probe sequence for 216922_x_at
gcatttcctgcttatccaaattcac

SEQ ID NO: 2036 - DNA, 25 bp, Artificial Sequence
  probe sequence for 216922_x_at
aaattcaccagttcaggtcaccact

SEQ ID NO: 2037 - DNA, 25 bp, Artificial Sequence
  probe sequence for 216922_x_at
aagttcaccatttcaggtcaccact

SEQ ID NO: 2038 - DNA, 25 bp, Artificial Sequence
  probe sequence for 216922_x_at
caaattcagcagttcaggtcaccac

SEQ ID NO: 2039 - DNA, 25 bp, Artificial Sequence
  probe sequence for 216922_x_at
tatacaattaccagatgccaccgca

SEQ ID NO: 2040 - DNA, 25 bp, Artificial Sequence
  probe sequence for 216922_x_at
tggtggtatcttgtctgtttaatcc

SEQ ID NO: 2041 - DNA, 25 bp, Artificial Sequence
  probe sequence for 215892_at
gcaaaaagatagcaatggcccattt

SEQ ID NO: 2042 - DNA, 25 bp, Artificial Sequence
  probe sequence for 215892_at
gcaatggcccatttgggaaaaacac

SEQ ID NO: 2043 - DNA, 25 bp, Artificial Sequence
  probe sequence for 215892_at
aagttcttgcttatattactgggaa

SEQ ID NO: 2044 - DNA, 25 bp, Artificial Sequence
  probe sequence for 215892_at
aaaagaggtcctgatcagatcccaa

SEQ ID NO: 2045 - DNA, 25 bp, Artificial Sequence
  probe sequence for 215892_at
agagttcttggatctcatacaggaa

SEQ ID NO: 2046 - DNA, 25 bp, Artificial Sequence
  probe sequence for 215892_at
aggaaggaattcaagacgagtcgga

SEQ ID NO: 2047 - DNA, 25 bp, Artificial Sequence
  probe sequence for 215892_at
gacgagtcggaaagtacagtgcaaa

SEQ ID NO: 2048 - DNA, 25 bp, Artificial Sequence
  probe sequence for 215892_at
ggccagcatgatggcttgggcctgt

SEQ ID NO: 2049 - DNA, 25 bp, Artificial Sequence
  probe sequence for 215892_at
gcatgatggcttgggcctgtggtct

SEQ ID NO: 2050 - DNA, 25 bp, Artificial Sequence
  probe sequence for 215892_at
tgggcctgtggtctaagcactttgg

SEQ ID NO: 2051 - DNA, 25 bp, Artificial Sequence
  probe sequence for 215892_at
gaggctggatgggacagtcgcttga

SEQ ID NO: 2052 - DNA, 25 bp, Artificial Sequence
  probe sequence for 203272_s_at
gcggctggggcaggttatggtagtg

SEQ ID NO: 2053 - DNA, 25 bp, Artificial Sequence
  probe sequence for 203272_s_at
tatggtagtgcggactgcggtgtga

SEQ ID NO: 2054 - DNA, 25 bp, Artificial Sequence
  probe sequence for 203272_s_at
agctgagcaagctttggtgcggcct

SEQ ID NO: 2055 - DNA, 25 bp, Artificial Sequence
  probe sequence for 203272_s_at
ccgcggctctatgttctatgatgag

SEQ ID NO: 2056 - DNA, 25 bp, Artificial Sequence
  probe sequence for 203272_s_at
gggatctggctcacgagttctatga

SEQ ID NO: 2057 - DNA, 25 bp, Artificial Sequence
  probe sequence for 203272_s_at
gagacaatcgtcaccaagaacgggc

SEQ ID NO: 2058 - DNA, 25 bp, Artificial Sequence
  probe sequence for 203272_s_at
agcgggccaagctgaggcgagtgca

SEQ ID NO: 2059 - DNA, 25 bp, Artificial Sequence
  probe sequence for 203272_s_at
tctgattcctcagggcatcgtgaag

SEQ ID NO: 2060 - DNA, 25 bp, Artificial Sequence
  probe sequence for 203272_s_at
gggcatcgtgaagctggatcacccc

SEQ ID NO: 2061 - DNA, 25 bp, Artificial Sequence
  probe sequence for 203272_s_at
atttccctgtgatcctctatgaggt

SEQ ID NO: 2062 - DNA, 25 bp, Artificial Sequence
  probe sequence for 203272_s_at
gctggggccacaaccctgaataaac

SEQ ID NO: 2063 - DNA, 25 bp, Artificial Sequence
  probe sequence for 201530_x_at
gatgcatgctcgagatttcactgta

SEQ ID NO: 2064 - DNA, 25 bp, Artificial Sequence
  probe sequence for 201530_x_at
tttcactgtatccgccatgcatgga

SEQ ID NO: 2065 - DNA, 25 bp, Artificial Sequence
  probe sequence for 201530_x_at
atgagggagtttcgttctggctcta

SEQ ID NO: 2066 - DNA, 25 bp, Artificial Sequence
  probe sequence for 201530_x_at
gagttttgattaccactgacctgct

SEQ ID NO: 2067 - DNA, 25 bp, Artificial Sequence
  probe sequence for 201530_x_at
actgacctgctggccagaggcattg

SEQ ID NO: 2068 - DNA, 25 bp, Artificial Sequence
  probe sequence for 201530_x_at
gtgcagcaggtttctttagtcatca

SEQ ID NO: 2069 - DNA, 25 bp, Artificial Sequence
  probe sequence for 201530_x_at
agtcatcaactatgaccttcccacc

SEQ ID NO: 2070 - DNA, 25 bp, Artificial Sequence
  probe sequence for 201530_x_at
cattgagaccttctacaacacctcc

SEQ ID NO: 2071 - DNA, 25 bp, Artificial Sequence
  probe sequence for 201530_x_at
aggaaatgcccctcaatgttgctga

SEQ ID NO: 2072 - DNA, 25 bp, Artificial Sequence
  probe sequence for 201530_x_at
gctgacctcatctgaggggctgtcc

SEQ ID NO: 2073 - DNA, 25 bp, Artificial Sequence
  probe sequence for 201530_x_at
ggacatcttgtcattttttttcttt

SEQ ID NO: 2074 - DNA, 25 bp, Artificial Sequence
  probe sequence for 217371_s_at
gaagatcttattcaatctatgcata

SEQ ID NO: 2075 - DNA, 25 bp, Artificial Sequence
  probe sequence for 217371_s_at
attgatgctactttatatacggaaa

SEQ ID NO: 2076 - DNA, 25 bp, Artificial Sequence
  probe sequence for 217371_s_at
ggaaagtgatgttcaccccagttgc

SEQ ID NO: 2077 - DNA, 25 bp, Artificial Sequence
  probe sequence for 217371_s_at
gatgttcaccccagttgcaaagtaa

SEQ ID NO: 2078 - DNA, 25 bp, Artificial Sequence
  probe sequence for 217371_s_at
acagcaatgaagtgctttctcttgg

SEQ ID NO: 2079 - DNA, 25 bp, Artificial Sequence
  probe sequence for 217371_s_at
gttatttcacttgagtccggagatg

SEQ ID NO: 2080 - DNA, 25 bp, Artificial Sequence
  probe sequence for 217371_s_at
gagtccggagatgcaagtattcatg

SEQ ID NO: 2081 - DNA, 25 bp, Artificial Sequence
  probe sequence for 217371_s_at
gtagaaaatctgatcatcctagcaa

SEQ ID NO: 2082 - DNA, 25 bp, Artificial Sequence
  probe sequence for 217371_s_at
tgatcatcctagcaaacaacagttt

SEQ ID NO: 2083 - DNA, 25 bp, Artificial Sequence
  probe sequence for 217371_s_at
acaacagtttgtcttctaatgggaa

SEQ ID NO: 2084 - DNA, 25 bp, Artificial Sequence
  probe sequence for 217371_s_at
gaatttttgcagagttttgtacata

SEQ ID NO: 2085 - DNA, 25 bp, Artificial Sequence
  probe sequence for 206279_at
gcagtacagtccttcctaataacgg

SEQ ID NO: 2086 - DNA, 25 bp, Artificial Sequence
  probe sequence for 206279_at
cagtccttcctaataacggggatgc

SEQ ID NO: 2087 - DNA, 25 bp, Artificial Sequence
  probe sequence for 206279_at
cctaataacggggatgctctgtcat

SEQ ID NO: 2088 - DNA, 25 bp, Artificial Sequence
  probe sequence for 206279_at
gtggacatgtctgttctgtatataa

SEQ ID NO: 2089 - DNA, 25 bp, Artificial Sequence
  probe sequence for 206279_at
gcaggtgggatttgaagcttttcca

SEQ ID NO: 2090 - DNA, 25 bp, Artificial Sequence
  probe sequence for 206279_at
gatttgaagcttttccacagtcctt

SEQ ID NO: 2091 - DNA, 25 bp, Artificial Sequence
  probe sequence for 206279_at
agctctgctcagctgtcacagctga

SEQ ID NO: 2092 - DNA, 25 bp, Artificial Sequence
  probe sequence for 206279_at
tgtcacagctgaattctttttttgt

SEQ ID NO: 2093 - DNA, 25 bp, Artificial Sequence
  probe sequence for 206279_at
gaattctttttttgtgctgaacact

SEQ ID NO: 2094 - DNA, 25 bp, Artificial Sequence
  probe sequence for 206279_at
ctttttttgtgctgaacactgggca

SEQ ID NO: 2095 - DNA, 25 bp, Artificial Sequence
  probe sequence for 206279_at
ttaatcttgtttgttgcgcaatgga

SEQ ID NO: 2096 - DNA, 25 bp, Artificial Sequence
  probe sequence for 222231_s_at
aattaagcattttcttgcctccttt

SEQ ID NO: 2097 - DNA, 25 bp, Artificial Sequence
  probe sequence for 222231_s_at
ctttgcttcatcttttcacaacagc

SEQ ID NO: 2098 - DNA, 25 bp, Artificial Sequence
  probe sequence for 222231_s_at
atggtgctcattcactgcaaactcc

SEQ ID NO: 2099 - DNA, 25 bp, Artificial Sequence
  probe sequence for 222231_s_at
tgcaaactcccagttgcaagctcct

SEQ ID NO: 2100 - DNA, 25 bp, Artificial Sequence
  probe sequence for 222231_s_at
gccttttagccctaatgaccttttg

SEQ ID NO: 2101 - DNA, 25 bp, Artificial Sequence
  probe sequence for 222231_s_at
gaccttttggatgggactgcaactc

SEQ ID NO: 2102 - DNA, 25 bp, Artificial Sequence
  probe sequence for 222231_s_at
gactgcaactcatgactatcctgat

SEQ ID NO: 2103 - DNA, 25 bp, Artificial Sequence
  probe sequence for 222231_s_at
ccatagctctgctgcgtaggtctac

SEQ ID NO: 2104 - DNA, 25 bp, Artificial Sequence
  probe sequence for 222231_s_at
gtaggtctacatcttactcagaatc

SEQ ID NO: 2105 - DNA, 25 bp, Artificial Sequence
  probe sequence for 222231_s_at
cactacacattcctttagtcttcct

SEQ ID NO: 2106 - DNA, 25 bp, Artificial Sequence
  probe sequence for 222231_s_at
ttcctccaagctccagagccattgg

SEQ ID NO: 2107 - DNA, 25 bp, Artificial Sequence
  probe sequence for 214912_at
aagagacccagttacagagctatgt

SEQ ID NO: 2108 - DNA, 25 bp, Artificial Sequence
  probe sequence for 214912_at
gaatgtcaattctaggtaacgatcc

SEQ ID NO: 2109 - DNA, 25 bp, Artificial Sequence
  probe sequence for 214912_at
aggtaacgatcctcaatgtcacagg

SEQ ID NO: 2110 - DNA, 25 bp, Artificial Sequence
  probe sequence for 214912_at
tcaatgtcacaggtacttcacgtat

SEQ ID NO: 2111 - DNA, 25 bp, Artificial Sequence
  probe sequence for 214912_at
cacgtattaatacctctttgccatt

SEQ ID NO: 2112 - DNA, 25 bp, Artificial Sequence
  probe sequence for 214912_at
gccattatacatatgtccttctcca

SEQ ID NO: 2113 - DNA, 25 bp, Artificial Sequence
  probe sequence for 214912_at
gtccttctccaaatgatggctcttt

SEQ ID NO: 2114 - DNA, 25 bp, Artificial Sequence
  probe sequence for 214912_at
ttgtcttctaagctggttgtgtgga

SEQ ID NO: 2115 - DNA, 25 bp, Artificial Sequence
  probe sequence for 214912_at
ctaccttccacattgtcttatagga

SEQ ID NO: 2116 - DNA, 25 bp, Artificial Sequence
  probe sequence for 214912_at
atgactctaattacagcactctggg

SEQ ID NO: 2117 - DNA, 25 bp, Artificial Sequence
  probe sequence for 214912_at
tagctggacctagtggtgggcgtct

SEQ ID NO: 2118 - DNA, 25 bp, Artificial Sequence
  probe sequence for 201729_s_at
ggctagactttgccatggctgtcaa

SEQ ID NO: 2119 - DNA, 25 bp, Artificial Sequence
  probe sequence for 201729_s_at
aaagggacagccgcaaagccctggt

SEQ ID NO: 2120 - DNA, 25 bp, Artificial Sequence
  probe sequence for 201729_s_at
aagtctgcaacaggctctgaggtcc

SEQ ID NO: 2121 - DNA, 25 bp, Artificial Sequence
  probe sequence for 201729_s_at
cccggctcctcattggtttaagtgt

SEQ ID NO: 2122 - DNA, 25 bp, Artificial Sequence
  probe sequence for 201729_s_at
agtccatctttggcaggcgcaaatg

SEQ ID NO: 2123 - DNA, 25 bp, Artificial Sequence
  probe sequence for 201729_s_at
ggcgattcgagtggctgcagtacag

SEQ ID NO: 2124 - DNA, 25 bp, Artificial Sequence
  probe sequence for 201729_s_at
gcagtacaggatctgactctggctc

SEQ ID NO: 2125 - DNA, 25 bp, Artificial Sequence
  probe sequence for 201729_s_at
caggctccagggacttgtggggtgg

SEQ ID NO: 2126 - DNA, 25 bp, Artificial Sequence
  probe sequence for 201729_s_at
gcttcccgttatccacgaggatttg

SEQ ID NO: 2127 - DNA, 25 bp, Artificial Sequence
  probe sequence for 201729_s_at
gtgtcagagcccataggcatcactc

SEQ ID NO: 2128 - DNA, 25 bp, Artificial Sequence
  probe sequence for 201729_s_at
agttctgtctcacactgatcaggct

SEQ ID NO: 2129 - DNA, 25 bp, Artificial Sequence
  probe sequence for 218265_at
taaggaaacttcctctccattgcag

SEQ ID NO: 2130 - DNA, 25 bp, Artificial Sequence
  probe sequence for 218265_at
tctccattgcagaatagctgagcca

SEQ ID NO: 2131 - DNA, 25 bp, Artificial Sequence
  probe sequence for 218265_at
tggaggttgccatggagggccattc

SEQ ID NO: 2132 - DNA, 25 bp, Artificial Sequence
  probe sequence for 218265_at
gccacttggcagaagggtgcagggc

SEQ ID NO: 2133 - DNA, 25 bp, Artificial Sequence
  probe sequence for 218265_at
gctacagggaaagggccctttctca

SEQ ID NO: 2134 - DNA, 25 bp, Artificial Sequence
  probe sequence for 218265_at
cctttctcaggggatgtagcttttt

SEQ ID NO: 2135 - DNA, 25 bp, Artificial Sequence
  probe sequence for 218265_at
gggaacacttggaggatttgctaaa

SEQ ID NO: 2136 - DNA, 25 bp, Artificial Sequence
  probe sequence for 218265_at
tggttttctaacctgtgactttttg

SEQ ID NO: 2137 - DNA, 25 bp, Artificial Sequence
  probe sequence for 218265_at
atgaattattcctttcagtctttat

SEQ ID NO: 2138 - DNA, 25 bp, Artificial Sequence
  probe sequence for 218265_at
atgtggtttctgtcttagaccagga

SEQ ID NO: 2139 - DNA, 25 bp, Artificial Sequence
  probe sequence for 218265_at
ggaggacagagtttgctttcatatt

SEQ ID NO: 2140 - DNA, 25 bp, Artificial Sequence
  probe sequence for 201537_s_at
gctgctctggaatatttcccttcga

SEQ ID NO: 2141 - DNA, 25 bp, Artificial Sequence
  probe sequence for 201537_s_at
atcttatctcagtcacttcgttttt

SEQ ID NO: 2142 - DNA, 25 bp, Artificial Sequence
  probe sequence for 201537_s_at
tagtgttggcaagcccaagccactc

SEQ ID NO: 2143 - DNA, 25 bp, Artificial Sequence
  probe sequence for 201537_s_at
cactcgtgctaactgctttttgtct

SEQ ID NO: 2144 - DNA, 25 bp, Artificial Sequence
  probe sequence for 201537_s_at
ctttttgtctcggttgctattccaa

SEQ ID NO: 2145 - DNA, 25 bp, Artificial Sequence
  probe sequence for 201537_s_at
gttggccaattacagcgtgtgtgca

SEQ ID NO: 2146 - DNA, 25 bp, Artificial Sequence
  probe sequence for 201537_s_at
cctctcagaaacgcggccagaagac

SEQ ID NO: 2147 - DNA, 25 bp, Artificial Sequence
  probe sequence for 201537_s_at
ggaagtgaaaggtcccaggcacaca

SEQ ID NO: 2148 - DNA, 25 bp, Artificial Sequence
  probe sequence for 201537_s_at
gcccattgcaggtggctcttacagc

SEQ ID NO: 2149 - DNA, 25 bp, Artificial Sequence
  probe sequence for 201537_s_at
gccagcacgggatccctgaagtgac

SEQ ID NO: 2150 - DNA, 25 bp, Artificial Sequence
  probe sequence for 201537_s_at
cagccctcacatgtgtatgcacatt

SEQ ID NO: 2151 - DNA, 25 bp, Artificial Sequence
  probe sequence for 221616_s_at
aatcgtggaactagtctcccttggt

SEQ ID NO: 2152 - DNA, 25 bp, Artificial Sequence
  probe sequence for 221616_s_at
aagattggtcagcacgacactggat

SEQ ID NO: 2153 - DNA, 25 bp, Artificial Sequence
  probe sequence for 221616_s_at
gacactggattgccagtctcacatc

SEQ ID NO: 2154 - DNA, 25 bp, Artificial Sequence
  probe sequence for 221616_s_at
gtctcacatcatctgcatcaacatt

SEQ ID NO: 2155 - DNA, 25 bp, Artificial Sequence
  probe sequence for 221616_s_at
taggtttcttagcatggctcgaata

SEQ ID NO: 2156 - DNA, 25 bp, Artificial Sequence
  probe sequence for 221616_s_at
gcatcatccagaattgtagtcacat

SEQ ID NO: 2157 - DNA, 25 bp, Artificial Sequence
  probe sequence for 221616_s_at
ataacccttggttcatactctgtga

SEQ ID NO: 2158 - DNA, 25 bp, Artificial Sequence
  probe sequence for 221616_s_at
gttcatactctgtgattcccatatc

SEQ ID NO: 2159 - DNA, 25 bp, Artificial Sequence
  probe sequence for 221616_s_at
tgtgattcccatatccttcaggatc

SEQ ID NO: 2160 - DNA, 25 bp, Artificial Sequence
  probe sequence for 221616_s_at
ggatctgtgccatcaccaaggcatc

SEQ ID NO: 2161 - DNA, 25 bp, Artificial Sequence
  probe sequence for 221616_s_at
catctctcggagcgttcttgggagg

SEQ ID NO: 2162 - DNA, 25 bp, Artificial Sequence
  probe sequence for 213106_at
acttctcagcaaataaatctccctt

SEQ ID NO: 2163 - DNA, 25 bp, Artificial Sequence
  probe sequence for 213106_at
ttgaattaacagcaactttccacag

SEQ ID NO: 2164 - DNA, 25 bp, Artificial Sequence
  probe sequence for 213106_at
tactatctgttgtttaactacttta

SEQ ID NO: 2165 - DNA, 25 bp, Artificial Sequence
  probe sequence for 213106_at
gccttggaaggcagctactacagaa

SEQ ID NO: 2166 - DNA, 25 bp, Artificial Sequence
  probe sequence for 213106_at
taaagtagtattttcagctccctga

SEQ ID NO: 2167 - DNA, 25 bp, Artificial Sequence
  probe sequence for 213106_at
agctccctgaaaaaccattcctgct

SEQ ID NO: 2168 - DNA, 25 bp, Artificial Sequence
  probe sequence for 213106_at
aatctgtggttatagtagttttctc

SEQ ID NO: 2169 - DNA, 25 bp, Artificial Sequence
  probe sequence for 213106_at
ttctcaggtttgtttatcttgatgt

SEQ ID NO: 2170 - DNA, 25 bp, Artificial Sequence
  probe sequence for 213106_at
tcttgatgtttgatgcactgtgttt

SEQ ID NO: 2171 - DNA, 25 bp, Artificial Sequence
  probe sequence for 213106_at
gttatgtgtcattggccttttgtga

SEQ ID NO: 2172 - DNA, 25 bp, Artificial Sequence
  probe sequence for 213106_at
aaacattttgtcctctaattgttat

SEQ ID NO: 2173 - DNA, 25 bp, Artificial Sequence
  probe sequence for 215336_at
tgctgcgtggcattaaggttctggc

SEQ ID NO: 2174 - DNA, 25 bp, Artificial Sequence
  probe sequence for 215336_at
tggcattaaggttctggcacagaga

SEQ ID NO: 2175 - DNA, 25 bp, Artificial Sequence
  probe sequence for 215336_at
aaaaagcggggctcatccaggattg

SEQ ID NO: 2176 - DNA, 25 bp, Artificial Sequence
  probe sequence for 215336_at
ccaggattggtggtgtgctcgttgc

SEQ ID NO: 2177 - DNA, 25 bp, Artificial Sequence
  probe sequence for 215336_at
gtgctcgttgcatatacagtgtcca

SEQ ID NO: 2178 - DNA, 25 bp, Artificial Sequence
  probe sequence for 215336_at
atatacagtgtccagggtctcacct

SEQ ID NO: 2179 - DNA, 25 bp, Artificial Sequence
  probe sequence for 215336_at
cagggtctcacctccagagatgaag

SEQ ID NO: 2180 - DNA, 25 bp, Artificial Sequence
  probe sequence for 215336_at
atgaagtcagtgaagggtcctgaga

SEQ ID NO: 2181 - DNA, 25 bp, Artificial Sequence
  probe sequence for 215336_at
gatgatttcagtgcaggtgattcag

SEQ ID NO: 2182 - DNA, 25 bp, Artificial Sequence
  probe sequence for 215336_at
cagagacctcacttgaaaatatatt

SEQ ID NO: 2183 - DNA, 25 bp, Artificial Sequence
  probe sequence for 215336_at
actgttcttttctgctacagagatc

SEQ ID NO: 2184 - DNA, 25 bp, Artificial Sequence
  probe sequence for 205917_at
gtggcagatcttgttttacactccc

SEQ ID NO: 2185 - DNA, 25 bp, Artificial Sequence
  probe sequence for 205917_at
tttccagtctattttctgtcttgtt

SEQ ID NO: 2186 - DNA, 25 bp, Artificial Sequence
  probe sequence for 205917_at
ttattgaccttccatggtcctcact

SEQ ID NO: 2187 - DNA, 25 bp, Artificial Sequence
  probe sequence for 205917_at
atggtcctcactgattgttttcttt

SEQ ID NO: 2188 - DNA, 25 bp, Artificial Sequence
  probe sequence for 205917_at
gttttctttgtcatacctaatctgt

SEQ ID NO: 2189 - DNA, 25 bp, Artificial Sequence
  probe sequence for 205917_at
ggtgggttcttttgtacaccttctg

SEQ ID NO: 2190 - DNA, 25 bp, Artificial Sequence
  probe sequence for 205917_at
aagtcatggttctctggtggtttgt

SEQ ID NO: 2191 - DNA, 25 bp, Artificial Sequence
  probe sequence for 205917_at
gaaagcccacagtcttctgagttgt

SEQ ID NO: 2192 - DNA, 25 bp, Artificial Sequence
  probe sequence for 205917_at
gtgctacaccaatatttctatgaac

SEQ ID NO: 2193 - DNA, 25 bp, Artificial Sequence
  probe sequence for 205917_at
atgtttgtaaaattccctagctctc

SEQ ID NO: 2194 - DNA, 25 bp, Artificial Sequence
  probe sequence for 205917_at
tccctagctctctgcactgagctga

SEQ ID NO: 2195 - DNA, 25 bp, Artificial Sequence
  probe sequence for 209770_at
ggaaatttggatgaagggagctaga

SEQ ID NO: 2196 - DNA, 25 bp, Artificial Sequence
  probe sequence for 209770_at
agtacagatgagggttcactatgtt

SEQ ID NO: 2197 - DNA, 25 bp, Artificial Sequence
  probe sequence for 209770_at
caccgggtgaccggcttacagggat

SEQ ID NO: 2198 - DNA, 25 bp, Artificial Sequence
  probe sequence for 209770_at
tgaccggcttacagggatattttta

SEQ ID NO: 2199 - DNA, 25 bp, Artificial Sequence
  probe sequence for 209770_at
ttaatcccgttatggactctgtctc

SEQ ID NO: 2200 - DNA, 25 bp, Artificial Sequence
  probe sequence for 209770_at
gtctccaggagaggggtctatccac

SEQ ID NO: 2201 - DNA, 25 bp, Artificial Sequence
  probe sequence for 209770_at
ctatccacccctgctcattggtgga

SEQ ID NO: 2202 - DNA, 25 bp, Artificial Sequence
  probe sequence for 209770_at
ccacccctgctcattggtggatgtt

SEQ ID NO: 2203 - DNA, 25 bp, Artificial Sequence
  probe sequence for 209770_at
ggaaaaactactcctcattatcatc

SEQ ID NO: 2204 - DNA, 25 bp, Artificial Sequence
  probe sequence for 209770_at
atcattattattgctctccactgta

SEQ ID NO: 2205 - DNA, 25 bp, Artificial Sequence
  probe sequence for 209770_at
ctctacctggcatgtgcttgtcaag

SEQ ID NO: 2206 - DNA, 25 bp, Artificial Sequence
  probe sequence for 209061_at
atctgaggtgagttgggggtatcta

SEQ ID NO: 2207 - DNA, 25 bp, Artificial Sequence
  probe sequence for 209061_at
ggcttgatgtcctagaagttctttg

SEQ ID NO: 2208 - DNA, 25 bp, Artificial Sequence
  probe sequence for 209061_at
agttctttgatccagaggtgggtgc

SEQ ID NO: 2209 - DNA, 25 bp, Artificial Sequence
  probe sequence for 209061_at
gaggtgggtgcagctgaaagtaaac

SEQ ID NO: 2210 - DNA, 25 bp, Artificial Sequence
  probe sequence for 209061_at
tgccagttacatgtatgcctgccca

SEQ ID NO: 2211 - DNA, 25 bp, Artificial Sequence
  probe sequence for 209061_at
ccagttccctttttatttgcagaag

SEQ ID NO: 2212 - DNA, 25 bp, Artificial Sequence
  probe sequence for 209061_at
ttttgttcacaattaggttcctagg

SEQ ID NO: 2213 - DNA, 25 bp, Artificial Sequence
  probe sequence for 209061_at
aacgagcagggtgttttctctcttc

SEQ ID NO: 2214 - DNA, 25 bp, Artificial Sequence
  probe sequence for 209061_at
caggaattgacttatactcttgaga

SEQ ID NO: 2215 - DNA, 25 bp, Artificial Sequence
  probe sequence for 209061_at
atgggggatggtgagctgtgactgc

SEQ ID NO: 2216 - DNA, 25 bp, Artificial Sequence
  probe sequence for 209061_at
actgctttgctgaccattttggatg

SEQ ID NO: 2217 - DNA, 25 bp, Artificial Sequence
  probe sequence for 202573_at
gcattgttgccaggggtgaggccgt

SEQ ID NO: 2218 - DNA, 25 bp, Artificial Sequence
  probe sequence for 202573_at
cgacacccggcaagcagccggagac

SEQ ID NO: 2219 - DNA, 25 bp, Artificial Sequence
  probe sequence for 202573_at
gcagccggagacaaaacgccttaaa

SEQ ID NO: 2220 - DNA, 25 bp, Artificial Sequence
  probe sequence for 202573_at
ctgcaggtatattgcaggggcctgg

SEQ ID NO: 2221 - DNA, 25 bp, Artificial Sequence
  probe sequence for 202573_at
ggctgccgggcagagtggagcagct

SEQ ID NO: 2222 - DNA, 25 bp, Artificial Sequence
  probe sequence for 202573_at
cagggcggtggctgtgagtctagtt

SEQ ID NO: 2223 - DNA, 25 bp, Artificial Sequence
  probe sequence for 202573_at
tgtgagtctagtttttgctttacca

SEQ ID NO: 2224 - DNA, 25 bp, Artificial Sequence
  probe sequence for 202573_at
tttttgctttaccaagtgtacagaa

SEQ ID NO: 2225 - DNA, 25 bp, Artificial Sequence
  probe sequence for 202573_at
aaatggcatttacgtttctctgatg

SEQ ID NO: 2226 - DNA, 25 bp, Artificial Sequence
  probe sequence for 202573_at
gcatttacgtttctctgatgctccc

SEQ ID NO: 2227 - DNA, 25 bp, Artificial Sequence
  probe sequence for 202573_at
tctgatgctcccttgaagccataga

SEQ ID NO: 2228 - DNA, 25 bp, Artificial Sequence
  probe sequence for 207064_s_at
aggacatcccaaacacagtgactct

SEQ ID NO: 2229 - DNA, 25 bp, Artificial Sequence
  probe sequence for 207064_s_at
ggaacagagttggcttcttgctccg

SEQ ID NO: 2230 - DNA, 25 bp, Artificial Sequence
  probe sequence for 207064_s_at
ctgcagcatcaatcctgtggcctgc

SEQ ID NO: 2231 - DNA, 25 bp, Artificial Sequence
  probe sequence for 207064_s_at
cacggcttctagtcctgagggtgtg

SEQ ID NO: 2232 - DNA, 25 bp, Artificial Sequence
  probe sequence for 207064_s_at
gttaggcacatgtacttttccctgt

SEQ ID NO: 2233 - DNA, 25 bp, Artificial Sequence
  probe sequence for 207064_s_at
tctccgtgtttttatcacacctgct

SEQ ID NO: 2234 - DNA, 25 bp, Artificial Sequence
  probe sequence for 207064_s_at
catcagtccctttggttaattctta

SEQ ID NO: 2235 - DNA, 25 bp, Artificial Sequence
  probe sequence for 207064_s_at
cttacttcctgttcatctctaaagt

SEQ ID NO: 2236 - DNA, 25 bp, Artificial Sequence
  probe sequence for 207064_s_at
aatatcacaaatcctactactcaga

SEQ ID NO: 2237 - DNA, 25 bp, Artificial Sequence
  probe sequence for 207064_s_at
tcacattacatcagacatctcttta

SEQ ID NO: 2238 - DNA, 25 bp, Artificial Sequence
  probe sequence for 207064_s_at
gacatctctttatgcatgtgcattc

SEQ ID NO: 2239 - DNA, 25 bp, Artificial Sequence
  probe sequence for 64371_at
gattccccagcactctgctgcgtgt

SEQ ID NO: 2240 - DNA, 25 bp, Artificial Sequence
  probe sequence for 64371_at
actctgctgcgtgtaactccactca

SEQ ID NO: 2241 - DNA, 25 bp, Artificial Sequence
  probe sequence for 64371_at
gctgcgtgtaactccactcaattct

SEQ ID NO: 2242 - DNA, 25 bp, Artificial Sequence
  probe sequence for 64371_at
ccactcatccttccttgtgaagcag

SEQ ID NO: 2243 - DNA, 25 bp, Artificial Sequence
  probe sequence for 64371_at
ccttgtgaagcaggatcgttgaagt

SEQ ID NO: 2244 - DNA, 25 bp, Artificial Sequence
  probe sequence for 64371_at
ggaaaacttaggatccctctgacac

SEQ ID NO: 2245 - DNA, 25 bp, Artificial Sequence
  probe sequence for 64371_at
ctctgacaccccaggattaggggac

SEQ ID NO: 2246 - DNA, 25 bp, Artificial Sequence
  probe sequence for 64371_at
caccccaggattaggggacacagca

SEQ ID NO: 2247 - DNA, 25 bp, Artificial Sequence
  probe sequence for 64371_at
cacagcagtggctagggcatcagcc

SEQ ID NO: 2248 - DNA, 25 bp, Artificial Sequence
  probe sequence for 64371_at
acagcagtggctagggcatcagcca

SEQ ID NO: 2249 - DNA, 25 bp, Artificial Sequence
  probe sequence for 64371_at
cagccacagaactgagcgggaaatg

SEQ ID NO: 2250 - DNA, 25 bp, Artificial Sequence
  probe sequence for 64371_at
cgggaaatgccacttgtattggctg

SEQ ID NO: 2251 - DNA, 25 bp, Artificial Sequence
  probe sequence for 64371_at
cttgtattggctgtaaagaaatcct

SEQ ID NO: 2252 - DNA, 25 bp, Artificial Sequence
  probe sequence for 64371_at
tgtaaagaaatcctggctttgggcc

SEQ ID NO: 2253 - DNA, 25 bp, Artificial Sequence
  probe sequence for 64371_at
gtaaagaaatcctggctttgggcca

SEQ ID NO: 2254 - DNA, 25 bp, Artificial Sequence
  probe sequence for 64371_at
gaaatcctggctttgggccaggcac

SEQ ID NO: 2255 - DNA, 25 bp, Artificial Sequence
  probe sequence for 219977_at
ggcagggagcaagtggcctggtcac

SEQ ID NO: 2256 - DNA, 25 bp, Artificial Sequence
  probe sequence for 219977_at
cctggtcacttctggttcgattgac

SEQ ID NO: 2257 - DNA, 25 bp, Artificial Sequence
  probe sequence for 219977_at
gaccaggatcgtggtgtcacttttt

SEQ ID NO: 2258 - DNA, 25 bp, Artificial Sequence
  probe sequence for 219977_at
attcttctggtagttttctctattt

SEQ ID NO: 2259 - DNA, 25 bp, Artificial Sequence
  probe sequence for 219977_at
tttctagattttaccccatgtcaat

SEQ ID NO: 2260 - DNA, 25 bp, Artificial Sequence
  probe sequence for 219977_at
ggatttgatgctctgatcctttctc

SEQ ID NO: 2261 - DNA, 25 bp, Artificial Sequence
  probe sequence for 219977_at
agttacatttgggggtcatctcggt

SEQ ID NO: 2262 - DNA, 25 bp, Artificial Sequence
  probe sequence for 219977_at
gggtcatctcggtgatttttgtaac

SEQ ID NO: 2263 - DNA, 25 bp, Artificial Sequence
  probe sequence for 219977_at
tacgcaggacacttagagctctcta

SEQ ID NO: 2264 - DNA, 25 bp, Artificial Sequence
  probe sequence for 219977_at
ctctctagaatcccactgactttag

SEQ ID NO: 2265 - DNA, 25 bp, Artificial Sequence
  probe sequence for 219977_at
actgactttagtggggtcttgatgt

SEQ ID NO: 2266 - DNA, 25 bp, Artificial Sequence
  probe sequence for 200772_x_at
gaaaagccatctttgcattgttcct

SEQ ID NO: 2267 - DNA, 25 bp, Artificial Sequence
  probe sequence for 200772_x_at
tgaactctcgctttctttttaatcc

SEQ ID NO: 2268 - DNA, 25 bp, Artificial Sequence
  probe sequence for 200772_x_at
caccatgtcagacgcagccgtagac

SEQ ID NO: 2269 - DNA, 25 bp, Artificial Sequence
  probe sequence for 200772_x_at
atgtcagacgcagccgtagacacca

SEQ ID NO: 2270 - DNA, 25 bp, Artificial Sequence
  probe sequence for 200772_x_at
agctccgaaatcaccaccaaggact

SEQ ID NO: 2271 - DNA, 25 bp, Artificial Sequence
  probe sequence for 200772_x_at
atcaccaccaaggacttaaaggaga

SEQ ID NO: 2272 - DNA, 25 bp, Artificial Sequence
  probe sequence for 200772_x_at
aagctgagtcagctacgggcaagcg

SEQ ID NO: 2273 - DNA, 25 bp, Artificial Sequence
  probe sequence for 200772_x_at
cagctacgggcaagcgggcagctga

SEQ ID NO: 2274 - DNA, 25 bp, Artificial Sequence
  probe sequence for 200772_x_at
gatgaggatgacgatgtcgatacca

SEQ ID NO: 2275 - DNA, 25 bp, Artificial Sequence
  probe sequence for 200772_x_at
gaagcagaagaccgacgaggatgac

SEQ ID NO: 2276 - DNA, 25 bp, Artificial Sequence
  probe sequence for 200772_x_at
agaccgacgaggatgactagacagc

SEQ ID NO: 2277 - DNA, 25 bp, Artificial Sequence
  probe sequence for 218617_at
gcagaaaagctcccaccattttctt

SEQ ID NO: 2278 - DNA, 25 bp, Artificial Sequence
  probe sequence for 218617_at
tggttttaaagtctcacgttctcta

SEQ ID NO: 2279 - DNA, 25 bp, Artificial Sequence
  probe sequence for 218617_at
agctccttgtgtggctgatgtgtct

SEQ ID NO: 2280 - DNA, 25 bp, Artificial Sequence
  probe sequence for 218617_at
ttaaaagcagcacagattccacatt

SEQ ID NO: 2281 - DNA, 25 bp, Artificial Sequence
  probe sequence for 218617_at
gaggatcttctttgtggtgaatacc

SEQ ID NO: 2282 - DNA, 25 bp, Artificial Sequence
  probe sequence for 218617_at
ataccaggattgactgcatcccttt

SEQ ID NO: 2283 - DNA, 25 bp, Artificial Sequence
  probe sequence for 218617_at
tatgtccctgactctggctaaaatt

SEQ ID NO: 2284 - DNA, 25 bp, Artificial Sequence
  probe sequence for 218617_at
gtgagccacatattgggagttctag

SEQ ID NO: 2285 - DNA, 25 bp, Artificial Sequence
  probe sequence for 218617_at
ggcaggaaagggccatctccattga

SEQ ID NO: 2286 - DNA, 25 bp, Artificial Sequence
  probe sequence for 218617_at
agactttgaaatttgcgagctgctc

SEQ ID NO: 2287 - DNA, 25 bp, Artificial Sequence
  probe sequence for 218617_at
cactgctgtctttctattgagttac

SEQ ID NO: 2288 - DNA, 25 bp, Artificial Sequence
  probe sequence for 214902_x_at
cccaaagtcttagttgcagggcact

SEQ ID NO: 2289 - DNA, 25 bp, Artificial Sequence
  probe sequence for 214902_x_at
gtaggagagcaatacctttgaaaag

SEQ ID NO: 2290 - DNA, 25 bp, Artificial Sequence
  probe sequence for 214902_x_at
gttgtcaaaactaatactcgtgtat

SEQ ID NO: 2291 - DNA, 25 bp, Artificial Sequence
  probe sequence for 214902_x_at
atttttgtcatttcacttttgtgga

SEQ ID NO: 2292 - DNA, 25 bp, Artificial Sequence
  probe sequence for 214902_x_at
tgatgtgatcaggctgggtgcgttg

SEQ ID NO: 2293 - DNA, 25 bp, Artificial Sequence
  probe sequence for 214902_x_at
atggtgaagccctgtttctactagg

SEQ ID NO: 2294 - DNA, 25 bp, Artificial Sequence
  probe sequence for 214902_x_at
aagccctgtttctactaggaataca

SEQ ID NO: 2295 - DNA, 25 bp, Artificial Sequence
  probe sequence for 214902_x_at
ggctgaagcaggagagtcgcttgaa

SEQ ID NO: 2296 - DNA, 25 bp, Artificial Sequence
  probe sequence for 214902_x_at
gagtcgcttgaacttgggaggtgga

SEQ ID NO: 2297 - DNA, 25 bp, Artificial Sequence
  probe sequence for 214902_x_at
cagtgagacgagattgcgccattgc

SEQ ID NO: 2298 - DNA, 25 bp, Artificial Sequence
  probe sequence for 214902_x_at
ctccaggctgggcgacagagtgaga

SEQ ID NO: 2299 - DNA, 25 bp, Artificial Sequence
  probe sequence for 207436_x_at
gtgctctcagagtagtagtgtttgt

SEQ ID NO: 2300 - DNA, 25 bp, Artificial Sequence
  probe sequence for 207436_x_at
gaggtcagatggcctggacacacaa

SEQ ID NO: 2301 - DNA, 25 bp, Artificial Sequence
  probe sequence for 207436_x_at
gaaactgagtctgccatgatatttt

SEQ ID NO: 2302 - DNA, 25 bp, Artificial Sequence
  probe sequence for 207436_x_at
aagggagctatgtcaaaatgtggtt

SEQ ID NO: 2303 - DNA, 25 bp, Artificial Sequence
  probe sequence for 207436_x_at
catagaactgcctggagggctccct

SEQ ID NO: 2304 - DNA, 25 bp, Artificial Sequence
  probe sequence for 207436_x_at
gagggctccctgacaaaacaaaaga

SEQ ID NO: 2305 - DNA, 25 bp, Artificial Sequence
  probe sequence for 207436_x_at
agaccagcgtggccaacatgatgaa

SEQ ID NO: 2306 - DNA, 25 bp, Artificial Sequence
  probe sequence for 207436_x_at
acatgatgaaacccagtctctacta

SEQ ID NO: 2307 - DNA, 25 bp, Artificial Sequence
  probe sequence for 207436_x_at
caggcatggtggcaggcctctgtat

SEQ ID NO: 2308 - DNA, 25 bp, Artificial Sequence
  probe sequence for 207436_x_at
gcctctgtattcccagctatttggg

SEQ ID NO: 2309 - DNA, 25 bp, Artificial Sequence
  probe sequence for 207436_x_at
aatcgcttgaattcgggaggcagag

SEQ ID NO: 2310 - DNA, 25 bp, Artificial Sequence
  probe sequence for 215659_at
ttcctaaatggtcttccttttccat

SEQ ID NO: 2311 - DNA, 25 bp, Artificial Sequence
  probe sequence for 215659_at
tctgcttttaatttagcgagctctt

SEQ ID NO: 2312 - DNA, 25 bp, Artificial Sequence
  probe sequence for 215659_at
gcgagctcttctcatgtgtttatca

SEQ ID NO: 2313 - DNA, 25 bp, Artificial Sequence
  probe sequence for 215659_at
gagggcagtttgcttactggttaag

SEQ ID NO: 2314 - DNA, 25 bp, Artificial Sequence
  probe sequence for 215659_at
aaggatgcaggctttagggctggaa

SEQ ID NO: 2315 - DNA, 25 bp, Artificial Sequence
  probe sequence for 215659_at
tagggctggaagcacctggtttcaa

SEQ ID NO: 2316 - DNA, 25 bp, Artificial Sequence
  probe sequence for 215659_at
agcacctggtttcaaagcctggctc

SEQ ID NO: 2317 - DNA, 25 bp, Artificial Sequence
  probe sequence for 215659_at
ctcttatcagctgcgtaacctttgg

SEQ ID NO: 2318 - DNA, 25 bp, Artificial Sequence
  probe sequence for 215659_at
gctgcgtaacctttggacaagttgc

SEQ ID NO: 2319 - DNA, 25 bp, Artificial Sequence
  probe sequence for 215659_at
gttgctttattgctctaagtttcag

SEQ ID NO: 2320 - DNA, 25 bp, Artificial Sequence
  probe sequence for 215659_at
ctcctgtgtcaactctagaggactg

SEQ ID NO: 2321 - DNA, 25 bp, Artificial Sequence
  probe sequence for 204216_s_at
agatgagtgaactgagtgtggcaca

SEQ ID NO: 2322 - DNA, 25 bp, Artificial Sequence
  probe sequence for 204216_s_at
ttttggagcgctgcaagtactggcc

SEQ ID NO: 2323 - DNA, 25 bp, Artificial Sequence
  probe sequence for 204216_s_at
gctgcaagtactggcctgcttgtaa

SEQ ID NO: 2324 - DNA, 25 bp, Artificial Sequence
  probe sequence for 204216_s_at
atggggatgagtgtgcctaccatca

SEQ ID NO: 2325 - DNA, 25 bp, Artificial Sequence
  probe sequence for 204216_s_at
tgcaaagccttccccaattgtaaat

SEQ ID NO: 2326 - DNA, 25 bp, Artificial Sequence
  probe sequence for 204216_s_at
gtgtactaaaccagattgtcccttc

SEQ ID NO: 2327 - DNA, 25 bp, Artificial Sequence
  probe sequence for 204216_s_at
ttgtcccttcactcatgtgagtaga

SEQ ID NO: 2328 - DNA, 25 bp, Artificial Sequence
  probe sequence for 204216_s_at
gaattccagtactgtctccaaaacc

SEQ ID NO: 2329 - DNA, 25 bp, Artificial Sequence
  probe sequence for 204216_s_at
gtcccttctatcatccaaaacattg

SEQ ID NO: 2330 - DNA, 25 bp, Artificial Sequence
  probe sequence for 204216_s_at
ctcaatgtacaagaccggactgcac

SEQ ID NO: 2331 - DNA, 25 bp, Artificial Sequence
  probe sequence for 204216_s_at
gtcctgcctggcagaagatcatgca

SEQ ID NO: 2332 - DNA, 25 bp, Artificial Sequence
  probe sequence for 214763_at
aggactccagcgtcaggatgttgcc

SEQ ID NO: 2333 - DNA, 25 bp, Artificial Sequence
  probe sequence for 214763_at
gcgtcaggatgttgccacttggagt

SEQ ID NO: 2334 - DNA, 25 bp, Artificial Sequence
  probe sequence for 214763_at
aatgggcacggggttttcagccaca

SEQ ID NO: 2335 - DNA, 25 bp, Artificial Sequence
  probe sequence for 214763_at
gccagtgttcagcaggatcatgcct

SEQ ID NO: 2336 - DNA, 25 bp, Artificial Sequence
  probe sequence for 214763_at
cagcaggatcatgccttctgtgtct

SEQ ID NO: 2337 - DNA, 25 bp, Artificial Sequence
  probe sequence for 214763_at
gggcagtgggagttatggggtcatc

SEQ ID NO: 2338 - DNA, 25 bp, Artificial Sequence
  probe sequence for 214763_at
tggggtcatcaaggaccttgcctct

SEQ ID NO: 2339 - DNA, 25 bp, Artificial Sequence
  probe sequence for 214763_at
gcctctctggaatctgtcaacccag

SEQ ID NO: 2340 - DNA, 25 bp, Artificial Sequence
  probe sequence for 214763_at
ggctccaggtggatgggttgcttta

SEQ ID NO: 2341 - DNA, 25 bp, Artificial Sequence
  probe sequence for 214763_at
gtgcctggtgcatgagaaactcttg

SEQ ID NO: 2342 - DNA, 25 bp, Artificial Sequence
  probe sequence for 214763_at
gcaatgtagctgaggactggtctga

SEQ ID NO: 2343 - DNA, 25 bp, Artificial Sequence
  probe sequence for 200877_at
gtggtatggaatcctactgcgttcg

SEQ ID NO: 2344 - DNA, 25 bp, Artificial Sequence
  probe sequence for 200877_at
gcgttcgtgcttttgcagatgctat

SEQ ID NO: 2345 - DNA, 25 bp, Artificial Sequence
  probe sequence for 200877_at
gtcattccatctacactagctgaaa

SEQ ID NO: 2346 - DNA, 25 bp, Artificial Sequence
  probe sequence for 200877_at
ctagctgaaaatgccggcctgaatc

SEQ ID NO: 2347 - DNA, 25 bp, Artificial Sequence
  probe sequence for 200877_at
ggcctgaatcccatttctacagtaa

SEQ ID NO: 2348 - DNA, 25 bp, Artificial Sequence
  probe sequence for 200877_at
gaactaagaaaccggcatgcccagg

SEQ ID NO: 2349 - DNA, 25 bp, Artificial Sequence
  probe sequence for 200877_at
tggaggaactggttgtccagcctct

SEQ ID NO: 2350 - DNA, 25 bp, Artificial Sequence
  probe sequence for 200877_at
ccagcctctgttggtatcagtcagt

SEQ ID NO: 2351 - DNA, 25 bp, Artificial Sequence
  probe sequence for 200877_at
cagtgctctgactcttgcaactgaa

SEQ ID NO: 2352 - DNA, 25 bp, Artificial Sequence
  probe sequence for 200877_at
gactagcaccattatgatcaccagt

SEQ ID NO: 2353 - DNA, 25 bp, Artificial Sequence
  probe sequence for 200877_at
tctgggcttggtcttccagttggca

SEQ ID NO: 2354 - DNA, 25 bp, Artificial Sequence
  probe sequence for 218425_at
catcactctggcccattgacagatg

SEQ ID NO: 2355 - DNA, 25 bp, Artificial Sequence
  probe sequence for 218425_at
ctggcccattgacagatgagaggtc

SEQ ID NO: 2356 - DNA, 25 bp, Artificial Sequence
  probe sequence for 218425_at
gatgagaggtctgaagccttcctgg

SEQ ID NO: 2357 - DNA, 25 bp, Artificial Sequence
  probe sequence for 218425_at
tgagaggctgggagttcacagacct

SEQ ID NO: 2358 - DNA, 25 bp, Artificial Sequence
  probe sequence for 218425_at
agttcacagacctcagacacagctg

SEQ ID NO: 2359 - DNA, 25 bp, Artificial Sequence
  probe sequence for 218425_at
acacagctgagtccgacaaccattg

SEQ ID NO: 2360 - DNA, 25 bp, Artificial Sequence
  probe sequence for 218425_at
gacaaccattggggtggggctgcat

SEQ ID NO: 2361 - DNA, 25 bp, Artificial Sequence
  probe sequence for 218425_at
ctgccattggcttctcagatgtatt

SEQ ID NO: 2362 - DNA, 25 bp, Artificial Sequence
  probe sequence for 218425_at
ggcttctcagatgtatttcaaggac

SEQ ID NO: 2363 - DNA, 25 bp, Artificial Sequence
  probe sequence for 218425_at
ggactaaagtgggctctaagatcta

SEQ ID NO: 2364 - DNA, 25 bp, Artificial Sequence
  probe sequence for 218425_at
ctaagatctaagatggcccggcgcg

SEQ ID NO: 2365 - DNA, 25 bp, Artificial Sequence
  probe sequence for 203246_s_at
ttgtgacactggtgtccatcctcca

SEQ ID NO: 2366 - DNA, 25 bp, Artificial Sequence
  probe sequence for 203246_s_at
gtactccaatgtatactgcccaacg

SEQ ID NO: 2367 - DNA, 25 bp, Artificial Sequence
  probe sequence for 203246_s_at
agaggcatgtctatcctacgtgacc

SEQ ID NO: 2368 - DNA, 25 bp, Artificial Sequence
  probe sequence for 203246_s_at
tctccgggatgtgttccagctatac

SEQ ID NO: 2369 - DNA, 25 bp, Artificial Sequence
  probe sequence for 203246_s_at
gctgatccagttcgggcttatgaag

SEQ ID NO: 2370 - DNA, 25 bp, Artificial Sequence
  probe sequence for 203246_s_at
gaagaacctcatcaggcgactacag

SEQ ID NO: 2371 - DNA, 25 bp, Artificial Sequence
  probe sequence for 203246_s_at
gactcgggaagagcagagccaccct

SEQ ID NO: 2372 - DNA, 25 bp, Artificial Sequence
  probe sequence for 203246_s_at
ggctttatacaggctgccacagcta

SEQ ID NO: 2373 - DNA, 25 bp, Artificial Sequence
  probe sequence for 203246_s_at
gaaaatgaccccaacatcatcatct

SEQ ID NO: 2374 - DNA, 25 bp, Artificial Sequence
  probe sequence for 203246_s_at
acacattgctgtgggtagtccctcc

SEQ ID NO: 2375 - DNA, 25 bp, Artificial Sequence
  probe sequence for 203246_s_at
aggaggcttgtcatactgtctagag

SEQ ID NO: 2376 - DNA, 25 bp, Artificial Sequence
  probe sequence for 203466_at
acagcgggattatcctgatgccctt

SEQ ID NO: 2377 - DNA, 25 bp, Artificial Sequence
  probe sequence for 203466_at
caactactatctatggcctgctgtg

SEQ ID NO: 2378 - DNA, 25 bp, Artificial Sequence
  probe sequence for 203466_at
tgcagttagccaacttctacctggt

SEQ ID NO: 2379 - DNA, 25 bp, Artificial Sequence
  probe sequence for 203466_at
tcccccttcattacaggttggccgt

SEQ ID NO: 2380 - DNA, 25 bp, Artificial Sequence
  probe sequence for 203466_at
acctgtcctggaaggcacatcggct

SEQ ID NO: 2381 - DNA, 25 bp, Artificial Sequence
  probe sequence for 203466_at
tgcagtgatgcagcttgaccctgga

SEQ ID NO: 2382 - DNA, 25 bp, Artificial Sequence
  probe sequence for 203466_at
gtcagacaacctcctcaaagtgggc

SEQ ID NO: 2383 - DNA, 25 bp, Artificial Sequence
  probe sequence for 203466_at
aagaggactagcacctgcaatgccc

SEQ ID NO: 2384 - DNA, 25 bp, Artificial Sequence
  probe sequence for 203466_at
tgccctcttcactctaaatgtacac

SEQ ID NO: 2385 - DNA, 25 bp, Artificial Sequence
  probe sequence for 203466_at
acactgactgctttagagcccttga

SEQ ID NO: 2386 - DNA, 25 bp, Artificial Sequence
  probe sequence for 203466_at
atatccagcaaatgccactcatccc

SEQ ID NO: 2387 - DNA, 25 bp, Artificial Sequence
  probe sequence for 204247_s_at
ccgtccgctgttactcagctgaggt

SEQ ID NO: 2388 - DNA, 25 bp, Artificial Sequence
  probe sequence for 204247_s_at
tcctctttggggccaagctgtactc

SEQ ID NO: 2389 - DNA, 25 bp, Artificial Sequence
  probe sequence for 204247_s_at
cacgtccatcgacatgtggtcagcc

SEQ ID NO: 2390 - DNA, 25 bp, Artificial Sequence
  probe sequence for 204247_s_at
gcctctttttcccggcaatgatgtc

SEQ ID NO: 2391 - DNA, 25 bp, Artificial Sequence
  probe sequence for 204247_s_at
gaccaagctgccagactataagccc

SEQ ID NO: 2392 - DNA, 25 bp, Artificial Sequence
  probe sequence for 204247_s_at
tataagccctatccgatgtacccgg

SEQ ID NO: 2393 - DNA, 25 bp, Artificial Sequence
  probe sequence for 204247_s_at
acaacatccctggtgaacgtcgtgc

SEQ ID NO: 2394 - DNA, 25 bp, Artificial Sequence
  probe sequence for 204247_s_at
cgtgcccaaactcaatgccacaggg

SEQ ID NO: 2395 - DNA, 25 bp, Artificial Sequence
  probe sequence for 204247_s_at
gccacagggagggatctgctgcaga

SEQ ID NO: 2396 - DNA, 25 bp, Artificial Sequence
  probe sequence for 204247_s_at
accttctgaagtgtaaccctgtcca

SEQ ID NO: 2397 - DNA, 25 bp, Artificial Sequence
  probe sequence for 204247_s_at
cctgtccagcgtatctcagcagaag

SEQ ID NO: 2398 - DNA, 25 bp, Artificial Sequence
  probe sequence for 216012_at
agaagtctgtatctggcatcttccc

SEQ ID NO: 2399 - DNA, 25 bp, Artificial Sequence
  probe sequence for 216012_at
ggaattaggatctcctttcagccct

SEQ ID NO: 2400 - DNA, 25 bp, Artificial Sequence
  probe sequence for 216012_at
ttcagccctatcttgggactgactt

SEQ ID NO: 2401 - DNA, 25 bp, Artificial Sequence
  probe sequence for 216012_at
cttacattcccacatgtgtccatgt

SEQ ID NO: 2402 - DNA, 25 bp, Artificial Sequence
  probe sequence for 216012_at
agtctagcttgccacacatgtgaaa

SEQ ID NO: 2403 - DNA, 25 bp, Artificial Sequence
  probe sequence for 216012_at
gaaatcattcccagttcacaggtgg

SEQ ID NO: 2404 - DNA, 25 bp, Artificial Sequence
  probe sequence for 216012_at
acttacatttcattgctgcatctgc

SEQ ID NO: 2405 - DNA, 25 bp, Artificial Sequence
  probe sequence for 216012_at
agagcaacttattcccttgtgacat

SEQ ID NO: 2406 - DNA, 25 bp, Artificial Sequence
  probe sequence for 216012_at
gacatgatgacacacctctggatag

SEQ ID NO: 2407 - DNA, 25 bp, Artificial Sequence
  probe sequence for 216012_at
tccctagtatcctattacctgtctg

SEQ ID NO: 2408 - DNA, 25 bp, Artificial Sequence
  probe sequence for 216012_at
gtacactgtgtaccttcgtatcact

SEQ ID NO: 2409 - DNA, 25 bp, Artificial Sequence
  probe sequence for 211328_x_at
ttttactgggcatctcctgagccta

SEQ ID NO: 2410 - DNA, 25 bp, Artificial Sequence
  probe sequence for 211328_x_at
gtagggtgacttctggagccatccc

SEQ ID NO: 2411 - DNA, 25 bp, Artificial Sequence
  probe sequence for 211328_x_at
gcggagacttaacggggacgtgcgg

SEQ ID NO: 2412 - DNA, 25 bp, Artificial Sequence
  probe sequence for 211328_x_at
agagctggggaaatgggcccgcgag

SEQ ID NO: 2413 - DNA, 25 bp, Artificial Sequence
  probe sequence for 211328_x_at
cctcttcatgggtgcctcagagcag

SEQ ID NO: 2414 - DNA, 25 bp, Artificial Sequence
  probe sequence for 211328_x_at
cagagcaggaccttggtctttccct

SEQ ID NO: 2415 - DNA, 25 bp, Artificial Sequence
  probe sequence for 211328_x_at
gtctttccctgtttgaagctttggg

SEQ ID NO: 2416 - DNA, 25 bp, Artificial Sequence
  probe sequence for 211328_x_at
tgggctacgtggatgacctcgtgat

SEQ ID NO: 2417 - DNA, 25 bp, Artificial Sequence
  probe sequence for 211328_x_at
ctgcccagccgtcaaaagagtctta

SEQ ID NO: 2418 - DNA, 25 bp, Artificial Sequence
  probe sequence for 211328_x_at
tatgttactacatgcacttggctgc

SEQ ID NO: 2419 - DNA, 25 bp, Artificial Sequence
  probe sequence for 211328_x_at
agggcaggtgcttcaggataccata

SEQ ID NO: 2420 - DNA, 25 bp, Artificial Sequence
  probe sequence for 218336_at
cggtgtccgcagagcaggtgattgc

SEQ ID NO: 2421 - DNA, 25 bp, Artificial Sequence
  probe sequence for 218336_at
agcaggtgattgctggcttcaaccg

SEQ ID NO: 2422 - DNA, 25 bp, Artificial Sequence
  probe sequence for 218336_at
ggcaggaacagcgaggcctggcatc

SEQ ID NO: 2423 - DNA, 25 bp, Artificial Sequence
  probe sequence for 218336_at
gagcacagcctagtgatcgatacac

SEQ ID NO: 2424 - DNA, 25 bp, Artificial Sequence
  probe sequence for 218336_at
aactcgtaagtgctaccgcatggtt

SEQ ID NO: 2425 - DNA, 25 bp, Artificial Sequence
  probe sequence for 218336_at
gagtgctggtggagcgaactgtcaa

SEQ ID NO: 2426 - DNA, 25 bp, Artificial Sequence
  probe sequence for 218336_at
tgctgcccgctttggagaacaacaa

SEQ ID NO: 2427 - DNA, 25 bp, Artificial Sequence
  probe sequence for 218336_at
attgagacactgacacagcagcttc

SEQ ID NO: 2428 - DNA, 25 bp, Artificial Sequence
  probe sequence for 218336_at
aaagcacaacattcgtctcatggga

SEQ ID NO: 2429 - DNA, 25 bp, Artificial Sequence
  probe sequence for 218336_at
gctcagctggagtgttggtctccta

SEQ ID NO: 2430 - DNA, 25 bp, Artificial Sequence
  probe sequence for 218336_at
ctcctagggaccaaggcctttgcat

SEQ ID NO: 2431 - DNA, 25 bp, Artificial Sequence
  probe sequence for 209746_s_at
atccgggtggatcatgcaggcgaat

SEQ ID NO: 2432 - DNA, 25 bp, Artificial Sequence
  probe sequence for 209746_s_at
acagttctgatgcccttgtggaacg

SEQ ID NO: 2433 - DNA, 25 bp, Artificial Sequence
  probe sequence for 209746_s_at
gaccgccttgctcgggaaggaaggt

SEQ ID NO: 2434 - DNA, 25 bp, Artificial Sequence
  probe sequence for 209746_s_at
ggaaggaaggtgccatggcctgcac

SEQ ID NO: 2435 - DNA, 25 bp, Artificial Sequence
  probe sequence for 209746_s_at
tggcctgcaccgtggcggtggaaga

SEQ ID NO: 2436 - DNA, 25 bp, Artificial Sequence
  probe sequence for 209746_s_at
gagagcatagcacatcactacaaca

SEQ ID NO: 2437 - DNA, 25 bp, Artificial Sequence
  probe sequence for 209746_s_at
gagcttgagcaccatgacataggcc

SEQ ID NO: 2438 - DNA, 25 bp, Artificial Sequence
  probe sequence for 209746_s_at
tgacataggcctcgaccatgatgca

SEQ ID NO: 2439 - DNA, 25 bp, Artificial Sequence
  probe sequence for 209746_s_at
tgcagaattggctccagcctatgcc

SEQ ID NO: 2440 - DNA, 25 bp, Artificial Sequence
  probe sequence for 209746_s_at
cagcctatgccgtcctgaagagcat

SEQ ID NO: 2441 - DNA, 25 bp, Artificial Sequence
  probe sequence for 209746_s_at
gagcattatccaggccggatgcaga

SEQ ID NO: 2442 - DNA, 25 bp, Artificial Sequence
  probe sequence for 214722_at
agtggttgtcagagactgtaagaag

SEQ ID NO: 2443 - DNA, 25 bp, Artificial Sequence
  probe sequence for 214722_at
gggaattggagagtgactgcccata

SEQ ID NO: 2444 - DNA, 25 bp, Artificial Sequence
  probe sequence for 214722_at
aattggagagtgactgcccataggt

SEQ ID NO: 2445 - DNA, 25 bp, Artificial Sequence
  probe sequence for 214722_at
tggagagtgactgcccataggtaca

SEQ ID NO: 2446 - DNA, 25 bp, Artificial Sequence
  probe sequence for 214722_at
gtggtgatggttgcagaacttttgg

SEQ ID NO: 2447 - DNA, 25 bp, Artificial Sequence
  probe sequence for 214722_at
ctcagtggtttactcttgtaatccc

SEQ ID NO: 2448 - DNA, 25 bp, Artificial Sequence
  probe sequence for 214722_at
ggtgatgtgtgcctagagttccaac

SEQ ID NO: 2449 - DNA, 25 bp, Artificial Sequence
  probe sequence for 214722_at
gatgtgtgcctagagttccaactac

SEQ ID NO: 2450 - DNA, 25 bp, Artificial Sequence
  probe sequence for 214722_at
gtgtgcctagagttccaactacttg

SEQ ID NO: 2451 - DNA, 25 bp, Artificial Sequence
  probe sequence for 214722_at
ggttgcagtgatctataatcaccac

SEQ ID NO: 2452 - DNA, 25 bp, Artificial Sequence
  probe sequence for 214722_at
agtgatctataatcaccactgcact

SEQ ID NO: 2453 - DNA, 25 bp, Artificial Sequence
  probe sequence for 214599_at
cataaataaccacccgcagtgtcca

SEQ ID NO: 2454 - DNA, 25 bp, Artificial Sequence
  probe sequence for 214599_at
gccctcagatcgtctcatacaaggg

SEQ ID NO: 2455 - DNA, 25 bp, Artificial Sequence
  probe sequence for 214599_at
tccacttatttcgggtccgctaggt

SEQ ID NO: 2456 - DNA, 25 bp, Artificial Sequence
  probe sequence for 214599_at
gtccctctacatgtctctttaatgg

SEQ ID NO: 2457 - DNA, 25 bp, Artificial Sequence
  probe sequence for 214599_at
ggaattattgtccagtgccaacccc

SEQ ID NO: 2458 - DNA, 25 bp, Artificial Sequence
  probe sequence for 214599_at
aacctcaggtgagcagagcctctac

SEQ ID NO: 2459 - DNA, 25 bp, Artificial Sequence
  probe sequence for 214599_at
gcagagcctctacttgagggactat

SEQ ID NO: 2460 - DNA, 25 bp, Artificial Sequence
  probe sequence for 214599_at
tataggaatccttacttccccagta

SEQ ID NO: 2461 - DNA, 25 bp, Artificial Sequence
  probe sequence for 214599_at
attttcttctatcacaccacataaa

SEQ ID NO: 2462 - DNA, 25 bp, Artificial Sequence
  probe sequence for 214599_at
cctgtgtatgggtcaatggctgcaa

SEQ ID NO: 2463 - DNA, 25 bp, Artificial Sequence
  probe sequence for 214599_at
tcaatggctgcaagagactcccacg

SEQ ID NO: 2464 - DNA, 25 bp, Artificial Sequence
  probe sequence for 220113_x_at
aggcttagcaggatgggcgcagtgg

SEQ ID NO: 2465 - DNA, 25 bp, Artificial Sequence
  probe sequence for 220113_x_at
cacgccactaatcccaacattttag

SEQ ID NO: 2466 - DNA, 25 bp, Artificial Sequence
  probe sequence for 220113_x_at
aggcaggagcaatcacttgtgcctg

SEQ ID NO: 2467 - DNA, 25 bp, Artificial Sequence
  probe sequence for 220113_x_at
gtgcctgggagttctagactagcct

SEQ ID NO: 2468 - DNA, 25 bp, Artificial Sequence
  probe sequence for 220113_x_at
ctgggcgagacttcatctctacaaa

SEQ ID NO: 2469 - DNA, 25 bp, Artificial Sequence
  probe sequence for 220113_x_at
tagccaagcatagtggcacacccct

SEQ ID NO: 2470 - DNA, 25 bp, Artificial Sequence
  probe sequence for 220113_x_at
agcaggaccctgtctctattttata

SEQ ID NO: 2471 - DNA, 25 bp, Artificial Sequence
  probe sequence for 220113_x_at
atcccaacactttggctcagcagat

SEQ ID NO: 2472 - DNA, 25 bp, Artificial Sequence
  probe sequence for 220113_x_at
ggctcagcagattgcttgaacccag

SEQ ID NO: 2473 - DNA, 25 bp, Artificial Sequence
  probe sequence for 220113_x_at
gaatctcctgagcctggaaggtcca

SEQ ID NO: 2474 - DNA, 25 bp, Artificial Sequence
  probe sequence for 220113_x_at
ggaaggtccaggcagtgagccaaga

SEQ ID NO: 2475 - DNA, 25 bp, Artificial Sequence
  probe sequence for 213212_x_at
gaaaatgtaaatcaaccctatccat

SEQ ID NO: 2476 - DNA, 25 bp, Artificial Sequence
  probe sequence for 213212_x_at
aaccctatccataatagattctcta

SEQ ID NO: 2477 - DNA, 25 bp, Artificial Sequence
  probe sequence for 213212_x_at
aactttatcttacagtcactttcaa

SEQ ID NO: 2478 - DNA, 25 bp, Artificial Sequence
  probe sequence for 213212_x_at
gtaactgctatattaacgtcttaaa

SEQ ID NO: 2479 - DNA, 25 bp, Artificial Sequence
  probe sequence for 213212_x_at
gaaatgccaattccagtccaaagct

SEQ ID NO: 2480 - DNA, 25 bp, Artificial Sequence
  probe sequence for 213212_x_at
aaagctgtatttgccaagttttctt

SEQ ID NO: 2481 - DNA, 25 bp, Artificial Sequence
  probe sequence for 213212_x_at
ttttcttagaatgacttttaccgat

SEQ ID NO: 2482 - DNA, 25 bp, Artificial Sequence
  probe sequence for 213212_x_at
taccgatttatgaattcttatacac

SEQ ID NO: 2483 - DNA, 25 bp, Artificial Sequence
  probe sequence for 213212_x_at
tactgatttttgtctaaagtggcat

SEQ ID NO: 2484 - DNA, 25 bp, Artificial Sequence
  probe sequence for 213212_x_at
aagtggcattattgactgctgctgt

SEQ ID NO: 2485 - DNA, 25 bp, Artificial Sequence
  probe sequence for 213212_x_at
tattgactgctgctgtgatgctact

SEQ ID NO: 2486 - DNA, 25 bp, Artificial Sequence
  probe sequence for 202842_s_at
gtttgatatttaccacagcgctgtg

SEQ ID NO: 2487 - DNA, 25 bp, Artificial Sequence
  probe sequence for 202842_s_at
gcgctgtgcctttctacagtagaac

SEQ ID NO: 2488 - DNA, 25 bp, Artificial Sequence
  probe sequence for 202842_s_at
ggttttattgcccatagtcatttag

SEQ ID NO: 2489 - DNA, 25 bp, Artificial Sequence
  probe sequence for 202842_s_at
atatttctttcttagttgttggcac

SEQ ID NO: 2490 - DNA, 25 bp, Artificial Sequence
  probe sequence for 202842_s_at
gttgttggcactcttaggtcttagt

SEQ ID NO: 2491 - DNA, 25 bp, Artificial Sequence
  probe sequence for 202842_s_at
gtgtgtgtgtagtttatcctctctc

SEQ ID NO: 2492 - DNA, 25 bp, Artificial Sequence
  probe sequence for 202842_s_at
gattgactgatacctcattctgttt

SEQ ID NO: 2493 - DNA, 25 bp, Artificial Sequence
  probe sequence for 202842_s_at
aatttctgtgcaaccttactatgtg

SEQ ID NO: 2494 - DNA, 25 bp, Artificial Sequence
  probe sequence for 202842_s_at
gtgtgcttttgttttcggatagact

SEQ ID NO: 2495 - DNA, 25 bp, Artificial Sequence
  probe sequence for 202842_s_at
atttctttagttctgcacttttcca

SEQ ID NO: 2496 - DNA, 25 bp, Artificial Sequence
  probe sequence for 202842_s_at
cacttttccacattatactccatat

SEQ ID NO: 2497 - DNA, 25 bp, Artificial Sequence
  probe sequence for 217671_at
gctaagaatgctgtccttcactttt

SEQ ID NO: 2498 - DNA, 25 bp, Artificial Sequence
  probe sequence for 217671_at
aggaatagtcaagttcccctatctc

SEQ ID NO: 2499 - DNA, 25 bp, Artificial Sequence
  probe sequence for 217671_at
aatacttactatctttaccactcac

SEQ ID NO: 2500 - DNA, 25 bp, Artificial Sequence
  probe sequence for 217671_at
taccactcactgctctattttgaga

SEQ ID NO: 2501 - DNA, 25 bp, Artificial Sequence
  probe sequence for 217671_at
aaaatgccctgtttgcataccttct

SEQ ID NO: 2502 - DNA, 25 bp, Artificial Sequence
  probe sequence for 217671_at
tgcataccttctcttctttgtatac

SEQ ID NO: 2503 - DNA, 25 bp, Artificial Sequence
  probe sequence for 217671_at
accttctcttctttgtatactgtaa

SEQ ID NO: 2504 - DNA, 25 bp, Artificial Sequence
  probe sequence for 217671_at
atactgtaaactcctgtataatagg

SEQ ID NO: 2505 - DNA, 25 bp, Artificial Sequence
  probe sequence for 217671_at
gttactctttaaggatattttcatt

SEQ ID NO: 2506 - DNA, 25 bp, Artificial Sequence
  probe sequence for 217671_at
attgaacttgtaatatatccagatt

SEQ ID NO: 2507 - DNA, 25 bp, Artificial Sequence
  probe sequence for 217671_at
gattaacatatgggccaagtgcagc

SEQ ID NO: 2508 - DNA, 25 bp, Artificial Sequence
  probe sequence for 207365_x_at
aggtccctcccacaacaatgggaat

SEQ ID NO: 2509 - DNA, 25 bp, Artificial Sequence
  probe sequence for 207365_x_at
tgggtggagacacggccaaactgta

SEQ ID NO: 2510 - DNA, 25 bp, Artificial Sequence
  probe sequence for 207365_x_at
gacacggccaaactgtatcacattg

SEQ ID NO: 2511 - DNA, 25 bp, Artificial Sequence
  probe sequence for 207365_x_at
cagatgttaattcctgtgactgact

SEQ ID NO: 2512 - DNA, 25 bp, Artificial Sequence
  probe sequence for 207365_x_at
gaaaggtaacctaaggctgggcacg

SEQ ID NO: 2513 - DNA, 25 bp, Artificial Sequence
  probe sequence for 207365_x_at
gggcacggtggctcgtgcctatagt

SEQ ID NO: 2514 - DNA, 25 bp, Artificial Sequence
  probe sequence for 207365_x_at
gcctatagtcctggcactttgagtg

SEQ ID NO: 2515 - DNA, 25 bp, Artificial Sequence
  probe sequence for 207365_x_at
ggtgggtggattgcttgaaaccagg

SEQ ID NO: 2516 - DNA, 25 bp, Artificial Sequence
  probe sequence for 207365_x_at
gaaacctcatccctacagaaaatac

SEQ ID NO: 2517 - DNA, 25 bp, Artificial Sequence
  probe sequence for 207365_x_at
cacacctgtagtctcagctactcgg

SEQ ID NO: 2518 - DNA, 25 bp, Artificial Sequence
  probe sequence for 207365_x_at
gagctcaggaggtcgaggcttcagt

SEQ ID NO: 2519 - DNA, 25 bp, Artificial Sequence
  probe sequence for 218067_s_at
gcttgttctaataggggctatgctc

SEQ ID NO: 2520 - DNA, 25 bp, Artificial Sequence
  probe sequence for 218067_s_at
ttttccttccactaagtcaaatcct

SEQ ID NO: 2521 - DNA, 25 bp, Artificial Sequence
  probe sequence for 218067_s_at
gtcaaatccttatcagatcattgtt

SEQ ID NO: 2522 - DNA, 25 bp, Artificial Sequence
  probe sequence for 218067_s_at
ttttcacctgtttggattctatatt

SEQ ID NO: 2523 - DNA, 25 bp, Artificial Sequence
  probe sequence for 218067_s_at
ggatggtctgataaggcttttactg

SEQ ID NO: 2524 - DNA, 25 bp, Artificial Sequence
  probe sequence for 218067_s_at
cccactgacttcagagttatactct

SEQ ID NO: 2525 - DNA, 25 bp, Artificial Sequence
  probe sequence for 218067_s_at
taatgctggttttgctgactttttg

SEQ ID NO: 2526 - DNA, 25 bp, Artificial Sequence
  probe sequence for 218067_s_at
ttggtgattgcattgggaaattccc

SEQ ID NO: 2527 - DNA, 25 bp, Artificial Sequence
  probe sequence for 218067_s_at
attcccagggtattactggacctat

SEQ ID NO: 2528 - DNA, 25 bp, Artificial Sequence
  probe sequence for 218067_s_at
tgttaaaccagtgtccttgtgatac

SEQ ID NO: 2529 - DNA, 25 bp, Artificial Sequence
  probe sequence for 218067_s_at
ccagcattccccattgtgtaaataa

SEQ ID NO: 2530 - DNA, 25 bp, Artificial Sequence
  probe sequence for 205238_at
gcggctgacttaaccttagatttca

SEQ ID NO: 2531 - DNA, 25 bp, Artificial Sequence
  probe sequence for 205238_at
ttcagattccctttcaatcatgccc

SEQ ID NO: 2532 - DNA, 25 bp, Artificial Sequence
  probe sequence for 205238_at
aatcatgcccgtttgcttgggtttg

SEQ ID NO: 2533 - DNA, 25 bp, Artificial Sequence
  probe sequence for 205238_at
tcctggatctggactgtttcttcct

SEQ ID NO: 2534 - DNA, 25 bp, Artificial Sequence
  probe sequence for 205238_at
tgctgtcagccttggttctagttta

SEQ ID NO: 2535 - DNA, 25 bp, Artificial Sequence
  probe sequence for 205238_at
tctagtttatagtcttgtctcctcc

SEQ ID NO: 2536 - DNA, 25 bp, Artificial Sequence
  probe sequence for 205238_at
cctccgtttctgcttatggtgtgga

SEQ ID NO: 2537 - DNA, 25 bp, Artificial Sequence
  probe sequence for 205238_at
actggagcctgtgcatttgctcaga

SEQ ID NO: 2538 - DNA, 25 bp, Artificial Sequence
  probe sequence for 205238_at
gttttcttggttttaaggcatctcg

SEQ ID NO: 2539 - DNA, 25 bp, Artificial Sequence
  probe sequence for 205238_at
gcatctcgaatgccccttgaaaatg

SEQ ID NO: 2540 - DNA, 25 bp, Artificial Sequence
  probe sequence for 205238_at
tgtagttttccctggtggtgggcac

SEQ ID NO: 2541 - DNA, 25 bp, Artificial Sequence
  probe sequence for 209432_s_at
gaggaaactccaggccatggtgatt

SEQ ID NO: 2542 - DNA, 25 bp, Artificial Sequence
  probe sequence for 209432_s_at
gctatgtactcctctgacacaaggg

SEQ ID NO: 2543 - DNA, 25 bp, Artificial Sequence
  probe sequence for 209432_s_at
agctgagcatggagtgttgtcccgc

SEQ ID NO: 2544 - DNA, 25 bp, Artificial Sequence
  probe sequence for 209432_s_at
ccagtgaggacccttaccagctgga

SEQ ID NO: 2545 - DNA, 25 bp, Artificial Sequence
  probe sequence for 209432_s_at
tgcctgccctgcagtcagaagtgcc

SEQ ID NO: 2546 - DNA, 25 bp, Artificial Sequence
  probe sequence for 209432_s_at
gcacacaccagtggttggacggctc

SEQ ID NO: 2547 - DNA, 25 bp, Artificial Sequence
  probe sequence for 209432_s_at
tggacggctcagactgtgtactcca

SEQ ID NO: 2548 - DNA, 25 bp, Artificial Sequence
  probe sequence for 209432_s_at
tgcctgctgcattacatgcctcagg

SEQ ID NO: 2549 - DNA, 25 bp, Artificial Sequence
  probe sequence for 209432_s_at
ccccctgcaggcaaatctcacaagg

SEQ ID NO: 2550 - DNA, 25 bp, Artificial Sequence
  probe sequence for 209432_s_at
ggaggatggcttcctactggtagcc

SEQ ID NO: 2551 - DNA, 25 bp, Artificial Sequence
  probe sequence for 209432_s_at
gcccctctgtcattttgcaggacag

SEQ ID NO: 2552 - DNA, 25 bp, Artificial Sequence
  probe sequence for 213919_at
atgaggaggaggcagtaccccagca

SEQ ID NO: 2553 - DNA, 25 bp, Artificial Sequence
  probe sequence for 213919_at
taccccagcacttgtttgttttgtt

SEQ ID NO: 2554 - DNA, 25 bp, Artificial Sequence
  probe sequence for 213919_at
gtggcctcacgctgtgaaactggga

SEQ ID NO: 2555 - DNA, 25 bp, Artificial Sequence
  probe sequence for 213919_at
ggagctgtgtgtttggtgggcagac

SEQ ID NO: 2556 - DNA, 25 bp, Artificial Sequence
  probe sequence for 213919_at
cttgtcatggactgtggttcgtgga

SEQ ID NO: 2557 - DNA, 25 bp, Artificial Sequence
  probe sequence for 213919_at
gtggagactttgggggactacctga

SEQ ID NO: 2558 - DNA, 25 bp, Artificial Sequence
  probe sequence for 213919_at
gactacctgagcggagctggtcatc

SEQ ID NO: 2559 - DNA, 25 bp, Artificial Sequence
  probe sequence for 213919_at
cacggctgagcacacggtatgcctc

SEQ ID NO: 2560 - DNA, 25 bp, Artificial Sequence
  probe sequence for 213919_at
tcagctccacaaagcggctgtgcag

SEQ ID NO: 2561 - DNA, 25 bp, Artificial Sequence
  probe sequence for 213919_at
agaaagctcgtttaacttcctcagt

SEQ ID NO: 2562 - DNA, 25 bp, Artificial Sequence
  probe sequence for 213919_at
tcagtgctggcaccaggatgcaccc

SEQ ID NO: 2563 - DNA, 25 bp, Artificial Sequence
  probe sequence for 221810_at
gggaagtaggtgatgccagccctca

SEQ ID NO: 2564 - DNA, 25 bp, Artificial Sequence
  probe sequence for 221810_at
ctgtcttcagccagggacttgagaa

SEQ ID NO: 2565 - DNA, 25 bp, Artificial Sequence
  probe sequence for 221810_at
cagtggctccaatctgtggaccagt

SEQ ID NO: 2566 - DNA, 25 bp, Artificial Sequence
  probe sequence for 221810_at
gaaggactatatttgtactgtaccc

SEQ ID NO: 2567 - DNA, 25 bp, Artificial Sequence
  probe sequence for 221810_at
gattttagggtgcagctacgctcac

SEQ ID NO: 2568 - DNA, 25 bp, Artificial Sequence
  probe sequence for 221810_at
taaacttttggtggcctggggcatg

SEQ ID NO: 2569 - DNA, 25 bp, Artificial Sequence
  probe sequence for 221810_at
ggggcatgtcttgaggcccagactg

SEQ ID NO: 2570 - DNA, 25 bp, Artificial Sequence
  probe sequence for 221810_at
tgctgtcttgagactccatccagcc

SEQ ID NO: 2571 - DNA, 25 bp, Artificial Sequence
  probe sequence for 221810_at
ccactatctccctgtgacgggtgaa

SEQ ID NO: 2572 - DNA, 25 bp, Artificial Sequence
  probe sequence for 221810_at
ggtgaacttcgtgtactgtgtctcg

SEQ ID NO: 2573 - DNA, 25 bp, Artificial Sequence
  probe sequence for 221810_at
gtactgtgtctcgggtccatatatg

SEQ ID NO: 2574 - DNA, 25 bp, Artificial Sequence
  probe sequence for 217923_at
ggggctgaggccacacagataggag

SEQ ID NO: 2575 - DNA, 25 bp, Artificial Sequence
  probe sequence for 217923_at
gaatgtcctgatggccatgagcagt

SEQ ID NO: 2576 - DNA, 25 bp, Artificial Sequence
  probe sequence for 217923_at
catgagcagttgagtggcacagcct

SEQ ID NO: 2577 - DNA, 25 bp, Artificial Sequence
  probe sequence for 217923_at
ggcaccaggagcaggtccttgtaat

SEQ ID NO: 2578 - DNA, 25 bp, Artificial Sequence
  probe sequence for 217923_at
agttagtgtccagtcagctgagctc

SEQ ID NO: 2579 - DNA, 25 bp, Artificial Sequence
  probe sequence for 217923_at
cagtggtgagtgttcatcggcctgt

SEQ ID NO: 2580 - DNA, 25 bp, Artificial Sequence
  probe sequence for 217923_at
atcggcctgttaccgttagtacctg

SEQ ID NO: 2581 - DNA, 25 bp, Artificial Sequence
  probe sequence for 217923_at
accaggccatcctgtcaaacgagcc

SEQ ID NO: 2582 - DNA, 25 bp, Artificial Sequence
  probe sequence for 217923_at
gatctgtctatgggaccagtggctt

SEQ ID NO: 2583 - DNA, 25 bp, Artificial Sequence
  probe sequence for 217923_at
tctgccacacccataaatccttgtg

SEQ ID NO: 2584 - DNA, 25 bp, Artificial Sequence
  probe sequence for 217923_at
ttgtgtgttaacttctagctgcctg

SEQ ID NO: 2585 - DNA, 25 bp, Artificial Sequence
  probe sequence for 210297_s_at
aatgaatgttctcctgggcagcgtt

SEQ ID NO: 2586 - DNA, 25 bp, Artificial Sequence
  probe sequence for 210297_s_at
tgggcagcgttgtgatctttgccac

SEQ ID NO: 2587 - DNA, 25 bp, Artificial Sequence
  probe sequence for 210297_s_at
accttcgtgactttatgcaatgcat

SEQ ID NO: 2588 - DNA, 25 bp, Artificial Sequence
  probe sequence for 210297_s_at
caatgcatcatgctatttcatacct

SEQ ID NO: 2589 - DNA, 25 bp, Artificial Sequence
  probe sequence for 210297_s_at
tcatacctaatgagggagttccagg

SEQ ID NO: 2590 - DNA, 25 bp, Artificial Sequence
  probe sequence for 210297_s_at
gtttctacacctgtgggttatgaca

SEQ ID NO: 2591 - DNA, 25 bp, Artificial Sequence
  probe sequence for 210297_s_at
ggttatgacaaagacaactgccaaa

SEQ ID NO: 2592 - DNA, 25 bp, Artificial Sequence
  probe sequence for 210297_s_at
ggactgcaagtatatcgtggtggag

SEQ ID NO: 2593 - DNA, 25 bp, Artificial Sequence
  probe sequence for 210297_s_at
ctgttctgtcagtgaatggataatc

SEQ ID NO: 2594 - DNA, 25 bp, Artificial Sequence
  probe sequence for 210297_s_at
tgcttctagtaggcacagggctccc

SEQ ID NO: 2595 - DNA, 25 bp, Artificial Sequence
  probe sequence for 210297_s_at
ctggcctctaatagtcaatgattgt

SEQ ID NO: 2596 - DNA, 25 bp, Artificial Sequence
  probe sequence for 202475_at
aaggcggcatctatgacttcattgg

SEQ ID NO: 2597 - DNA, 25 bp, Artificial Sequence
  probe sequence for 202475_at
ccttgtcatgtcccggaatgccggc

SEQ ID NO: 2598 - DNA, 25 bp, Artificial Sequence
  probe sequence for 202475_at
tgctgagcttattatgtcccgctgc

SEQ ID NO: 2599 - DNA, 25 bp, Artificial Sequence
  probe sequence for 202475_at
agcccggggcattgagtttgactgg

SEQ ID NO: 2600 - DNA, 25 bp, Artificial Sequence
  probe sequence for 202475_at
atcagtctgggtccatacatcgtcg

SEQ ID NO: 2601 - DNA, 25 bp, Artificial Sequence
  probe sequence for 202475_at
cgcgtctgctcaggtctggatgata

SEQ ID NO: 2602 - DNA, 25 bp, Artificial Sequence
  probe sequence for 202475_at
taacacgctatgatctgtaccacac

SEQ ID NO: 2603 - DNA, 25 bp, Artificial Sequence
  probe sequence for 202475_at
ctcctgctgatgttcctcagagttt

SEQ ID NO: 2604 - DNA, 25 bp, Artificial Sequence
  probe sequence for 202475_at
tatggagacgtttgtccacctatgc

SEQ ID NO: 2605 - DNA, 25 bp, Artificial Sequence
  probe sequence for 202475_at
ttgccgttgtcaatgtgcactccta

SEQ ID NO: 2606 - DNA, 25 bp, Artificial Sequence
  probe sequence for 202475_at
tcctaggcttggtgtctcagacatt

SEQ ID NO: 2607 - DNA, 25 bp, Artificial Sequence
  probe sequence for 206160_at
aggaggctggctgtaaactgcgcat

SEQ ID NO: 2608 - DNA, 25 bp, Artificial Sequence
  probe sequence for 206160_at
taaactgcgcatcatgaagccccag

SEQ ID NO: 2609 - DNA, 25 bp, Artificial Sequence
  probe sequence for 206160_at
agccccaggacttcgaatatgtctg

SEQ ID NO: 2610 - DNA, 25 bp, Artificial Sequence
  probe sequence for 206160_at
gtagggcaactgggctttgcctcac

SEQ ID NO: 2611 - DNA, 25 bp, Artificial Sequence
  probe sequence for 206160_at
tacagccatctgggacatgcctgtc

SEQ ID NO: 2612 - DNA, 25 bp, Artificial Sequence
  probe sequence for 206160_at
tgcctgtcttcctaataccatttgg

SEQ ID NO: 2613 - DNA, 25 bp, Artificial Sequence
  probe sequence for 206160_at
caatcatactggacaaggcccttag

SEQ ID NO: 2614 - DNA, 25 bp, Artificial Sequence
  probe sequence for 206160_at
aaccatacatgggctccagtcaact

SEQ ID NO: 2615 - DNA, 25 bp, Artificial Sequence
  probe sequence for 206160_at
gactgaaggtcctaattgctcaccc

SEQ ID NO: 2616 - DNA, 25 bp, Artificial Sequence
  probe sequence for 206160_at
ttgctcacccaagggggctgcttaa

SEQ ID NO: 2617 - DNA, 25 bp, Artificial Sequence
  probe sequence for 206160_at
acacaaacagcctcagacccgaggt

SEQ ID NO: 2618 - DNA, 25 bp, Artificial Sequence
  probe sequence for 215275_at
tagggactccaaaggcagctgacag

SEQ ID NO: 2619 - DNA, 25 bp, Artificial Sequence
  probe sequence for 215275_at
gctgacagcatctggctttcagttc

SEQ ID NO: 2620 - DNA, 25 bp, Artificial Sequence
  probe sequence for 215275_at
agtcaccactactttgtaccaaatt

SEQ ID NO: 2621 - DNA, 25 bp, Artificial Sequence
  probe sequence for 215275_at
gtaccaaattcactgttttggctct

SEQ ID NO: 2622 - DNA, 25 bp, Artificial Sequence
  probe sequence for 215275_at
ggatgtctgcattgctcatgcaaat

SEQ ID NO: 2623 - DNA, 25 bp, Artificial Sequence
  probe sequence for 215275_at
acaccatcaccacccaaatgaaaag

SEQ ID NO: 2624 - DNA, 25 bp, Artificial Sequence
  probe sequence for 215275_at
tcatcagcctactaatgtcatctcc

SEQ ID NO: 2625 - DNA, 25 bp, Artificial Sequence
  probe sequence for 215275_at
ctccatcccaaaaaagcatccagtt

SEQ ID NO: 2626 - DNA, 25 bp, Artificial Sequence
  probe sequence for 215275_at
agcatccagttcagaattgcccact

SEQ ID NO: 2627 - DNA, 25 bp, Artificial Sequence
  probe sequence for 215275_at
ctgagaaacctaccctggtgaccaa

SEQ ID NO: 2628 - DNA, 25 bp, Artificial Sequence
  probe sequence for 215275_at
gaattggcaggttttgcttcaaaat

SEQ ID NO: 2629 - DNA, 25 bp, Artificial Sequence
  probe sequence for 214463_x_at
atgtctggccgcggcaaaggcggga

SEQ ID NO: 2630 - DNA, 25 bp, Artificial Sequence
  probe sequence for 214463_x_at
gctaagcgccaccgtaaagtactgc

SEQ ID NO: 2631 - DNA, 25 bp, Artificial Sequence
  probe sequence for 214463_x_at
gcgacaatatccagggcatcaccaa

SEQ ID NO: 2632 - DNA, 25 bp, Artificial Sequence
  probe sequence for 214463_x_at
cttgctcgccgcggcggcgtgaagc

SEQ ID NO: 2633 - DNA, 25 bp, Artificial Sequence
  probe sequence for 214463_x_at
atctccggcctcatctacgaggaga

SEQ ID NO: 2634 - DNA, 25 bp, Artificial Sequence
  probe sequence for 214463_x_at
gactcgcggggtgctgaaggtgttc

SEQ ID NO: 2635 - DNA, 25 bp, Artificial Sequence
  probe sequence for 214463_x_at
gttcctggagaacgtgatccgggac

SEQ ID NO: 2636 - DNA, 25 bp, Artificial Sequence
  probe sequence for 214463_x_at
gacctatacagagcacgccaagcgc

SEQ ID NO: 2637 - DNA, 25 bp, Artificial Sequence
  probe sequence for 214463_x_at
gtcaccgccatggatgtggtctacg

SEQ ID NO: 2638 - DNA, 25 bp, Artificial Sequence
  probe sequence for 214463_x_at
tacggtttcggtggttgagcgtcct

SEQ ID NO: 2639 - DNA, 25 bp, Artificial Sequence
  probe sequence for 214463_x_at
tgagcgtccttttctaccaataaaa

SEQ ID NO: 2640 - DNA, 25 bp, Artificial Sequence
  probe sequence for 201145_at
tgatgcaagaagtgaatccccccaa

SEQ ID NO: 2641 - DNA, 25 bp, Artificial Sequence
  probe sequence for 201145_at
gatgatgtatggcctatggaccccc

SEQ ID NO: 2642 - DNA, 25 bp, Artificial Sequence
  probe sequence for 201145_at
agagcatctctgtgaccaagatcac

SEQ ID NO: 2643 - DNA, 25 bp, Artificial Sequence
  probe sequence for 201145_at
tgagggccggacagagactacagta

SEQ ID NO: 2644 - DNA, 25 bp, Artificial Sequence
  probe sequence for 201145_at
agactacagtaacccgacacgaagc

SEQ ID NO: 2645 - DNA, 25 bp, Artificial Sequence
  probe sequence for 201145_at
gatagcagtcctaggggtgatccag

SEQ ID NO: 2646 - DNA, 25 bp, Artificial Sequence
  probe sequence for 201145_at
gccctggatgatgccttttccatcc

SEQ ID NO: 2647 - DNA, 25 bp, Artificial Sequence
  probe sequence for 201145_at
tccatcctggacttattcctgggac

SEQ ID NO: 2648 - DNA, 25 bp, Artificial Sequence
  probe sequence for 201145_at
gtagccttgttaaccctcagaggcc

SEQ ID NO: 2649 - DNA, 25 bp, Artificial Sequence
  probe sequence for 201145_at
ttgccacctcaggggcttggatatg

SEQ ID NO: 2650 - DNA, 25 bp, Artificial Sequence
  probe sequence for 201145_at
tttgtcactcacccaaactgaccaa

We claim:

1. A method of processing a sample of airway epithelial cells from a subject who is asymptomatic for lung cancer, comprising:
    (a) receiving a sample of airway epithelial cells from the subject who is asymptomatic for lung cancer; and
    (b) measuring, by reverse-transcription polymerase chain reaction (RT-PCR) analysis, the expression level of gene transcripts in the sample, wherein the gene transcripts measured comprise IL-8, FOS, and BACH2.

2. The method of claim 1 wherein the gene transcripts measured further comprise DEFB1.

3. The method of claim 2 wherein the gene transcripts measured further comprise CCDC81.

4. The method of claim 1 further comprising measuring a gene transcript selected from Table 1.

5. The method of claim 1 further comprising measuring a gene transcript selected from Table 3.

6. The method of claim 1 further comprising measuring a gene transcript selected from Table 4.

7. The method of claim 1 further comprising measuring a gene transcript selected from Table 5.

8. The method of claim 1 further comprising measuring a gene transcript selected from Table 6.

9. The method of claim 1 further comprising measuring a gene transcript selected from Table 7.

10. The method of claim 1 wherein transcripts of at least 40 genes are measured.

11. The method of claim 1 wherein transcripts of at least 60 genes are measured.

12. The method of claim 1 wherein transcripts of at least 70 genes are measured.

13. The method of claim 1 wherein the airway epithelial cells are not from the bronchus.

14. The method of claim 1 wherein transcripts of no more than 180 genes are measured.

* * * * *